United States Patent 7,655,785 (BIOINFORMATICALLY DETECTABLE GROUP OF NOVEL REGULATORY OLIGONUCLEOTIDES AND USES THEREOF) - sequence listing, part 54

SEQ ID NO: 2241090 - RNA, 94 nt, Homo sapiens
uaauauguugaguagaaggggugaaagugggcauccuugucuuauucuaguucuuaggaggauugcuuucaucuuuuccccauucaauauguug

SEQ ID NO: 2241091 - RNA, 114 nt, Homo sapiens
ggucucucucugccacccagguuggaguauaguggcaugaucauagcucacugcauccuugaacucuugggcucaagugauuaucccaucucagccucccaaguaguuaggacu

SEQ ID NO: 2241092 - RNA, 116 nt, Homo sapiens
ucccauuuuauagauaaggaagcugagguucaagaagguuaaacagcucugccaaggucauacagauggcauuugaccucuggacccucugaagcuuucucucugcuacaugagga

SEQ ID NO: 2241093 - RNA, 72 nt, Homo sapiens
ggauccaugguauggcaguuucagcuauaguuuuugcucagggauuuauuguuggaauucuauccuggaucu

SEQ ID NO: 2241094 - RNA, 66 nt, Homo sapiens
uugcagauucguuuugagggguagaaguauuugcagucuaaccccgauacaaugaauuuuuugcag

SEQ ID NO: 2241095 - RNA, 70 nt, Homo sapiens
cauagcacugagcucuacccucaguuacucuucuuucacugucuguugcagguaguaaguugagugcaug

SEQ ID NO: 2241096 - RNA, 64 nt, Homo sapiens
cucuauugaaguguucaguagaagcauugauaaugggcauccuucucuaguuacuuuaauggag

SEQ ID NO: 2241097 - RNA, 68 nt, Homo sapiens
ggcccaaaaugugcuuucuuucacacaguaccuaugagcuuggacuguggagcuagagaacaucugcc

SEQ ID NO: 2241098 - RNA, 98 nt, Homo sapiens
ggcaggagaaucgcuugaaugcggcaggcggagguugcggugagcugagaucgugccauugcacuccagucugggcaacaagagggaaacuccguguc

SEQ ID NO: 2241099 - RNA, 113 nt, Homo sapiens
ugcaguuugaaauggcuggagagaagagagcuugggguguuaaauucagacuaaagcuaucucuacauauucuaaguuuggccuaaaaguuccuccauacauuguaagcugca

SEQ ID NO: 2241100 - RNA, 86 nt, Homo sapiens
uuagccucuuuacuugagaucauuaugucaggggucauuagaaacugaauugaaccauauauaauguucuugauuagggauguuag

SEQ ID NO: 2241101 - RNA, 78 nt, Homo sapiens
augcuuggaaccaaaaguauuuuggaucucagauuuucucagauuugggaaugugcauuauacuuacagguuaagcau

SEQ ID NO: 2241102 - RNA, 57 nt, Homo sapiens
uuggccgugucauuugcuuugacucauggaaugugggugggacaaaaagcaugccag

SEQ ID NO: 2241103 - RNA, 98 nt, Homo sapiens
cagggccuccaagcucacucagaaaucuuguguugaauggugcagagcuaaguuguucacucugcaguaucauauuagaagagauuugguuuacccug

SEQ ID NO: 2241104 - RNA, 62 nt, Homo sapiens
gcuguucuggagccgguucaaauggggucauaucgcccccgugugguaaaucucugaacagc

SEQ ID NO: 2241105 - RNA, 118 nt, Homo sapiens
uauagaugaagaaucaaaguuuugguaucacagauauggguuuaaauccuggcuuucagugguugcuagcccaugauuuggagcaauauuucuaagaccucuugccuucucaucuaua

SEQ ID NO: 2241106 - RNA, 65 nt, Homo sapiens
uguggaggaccaauuaugcauugugaguuuuaucauuuucacugcauuggaugguuccucccaca

SEQ ID NO: 2241107 - RNA, 57 nt, Homo sapiens
ucacccucugugcuuagcacagcacuuggcccgugcugagugcugagugaggguuga

SEQ ID NO: 2241108 - RNA, 100 nt, Homo sapiens
ugaggcaggaaacuugcuugaacccagagggcagagguugcagugagccgaguucgugccacugcacuccagcccggcaacagagcaagacuccaccuca

SEQ ID NO: 2241109 - RNA, 57 nt, Homo sapiens
ccuggaguaugauguuagcguugggcuuuucagauaaugccuuuauuauauuugagg

SEQ ID NO: 2241110 - RNA, 70 nt, Homo sapiens
cuuccugagcuuccaguuccuccaggaugccuccagugcaaggcccuggcaagagacugaagauaggaag

SEQ ID NO: 2241111 - RNA, 82 nt, Homo sapiens
auuugucacaaaaauguacauucaaccauuuccugaauuucuggagauucugaguggcagaaugagcugaggugugauagau

SEQ ID NO: 2241112 - RNA, 74 nt, Homo sapiens
gcuauugucacauugaugcccaugguggaugggcuaagcauaggcagccaucaggggcuucggguggagauagu

SEQ ID NO: 2241113 - RNA, 57 nt, Homo sapiens
aucaccuuacuugcuucugaacugguuguagugccagggauauaaauuuaaggugau

SEQ ID NO: 2241114 - RNA, 61 nt, Homo sapiens
gcugucagcaucaauuuucuuaagguguguauccucauggugucaagaugacugcugcggc

SEQ ID NO: 2241115 - RNA, 55 nt, Homo sapiens
agccauauauguuuguauaugcauuuagaaacccaaaugcaaacauguguguguu

SEQ ID NO: 2241116 - RNA, 80 nt, Homo sapiens
gacaaguaaauacucauugaaugaaauggcagacacuuugaacuaguuaaauugugccugcugcucauuuguacucuguc

SEQ ID NO: 2241117 - RNA, 112 nt, Homo sapiens
aaaaucauaaaaaauaacacucuacugucagucuuuuuuuggcaagcauuaaggguaaguggucuuggggauguauugucaggugaagaauggcauaauuuauuaugauuuu

SEQ ID NO: 2241118 - RNA, 126 nt, Homo sapiens
uauuuggaaauagggccuuugcagauguucaaguuaacaugagauggagucuugcucugucgcccaggcuggaguguaguggcuccaucucggcucacugcaacaucccgguuucguguucaagug

SEQ ID NO: 2241119 - RNA, 67 nt, Homo sapiens
acucacauauguguauucucauuuacauaagauaauucaagaaaugaguagguccacguaugugagu

SEQ ID NO: 2241120 - RNA, 114 nt, Homo sapiens
uuguugguggcauuucaucgaggauccaugguauggcaguuucagcuauaguuuuugcucagggauuuauuguuggaauucuauccuggaucuauguugugacugucuuagcga

SEQ ID NO: 2241121 - RNA, 56 nt, Homo sapiens
gcuacugugaauagugcaacaguaaauguaugugugcaugcaucuuuuauaguagc

SEQ ID NO: 2241122 - RNA, 68 nt, Homo sapiens
uccuaguuauugaaugucuauuaaguuguuuugacauucaaguuuauuuagcagauauuuauugagga

SEQ ID NO: 2241123 - RNA, 67 nt, Homo sapiens
augagauuuggguggggacaaagagccaaaccguaucauuuugccucuggccccucucaaaucucau

SEQ ID NO: 2241124 - RNA, 62 nt, Homo sapiens
agaggcuuuggaauauucuucuggauuaccauguaauauccugacguguuuuccagaccuuu

SEQ ID NO: 2241125 - RNA, 72 nt, Homo sapiens
aggaaugcuuuuacacuguuggugggaguguaaauuaguucaaccacuguggaagacaguguggcaauuccu

SEQ ID NO: 2241126 - RNA, 74 nt, Homo sapiens
uguuacuguacugaauacuguagacaguuguaacacaauuguuacacaaugguaaguguuuguguauugaaaca

SEQ ID NO: 2241127 - RNA, 69 nt, Homo sapiens
gugaggucagggcuguggacaggaucacacaagacaggccagaugugcuguucacucuccugcccuuac

SEQ ID NO: 2241128 - RNA, 75 nt, Homo sapiens
uaguugaaaagcaagcagacuuaggaacaugacuggagaaagaagucaugaagcuagcugauugcugauagauug

SEQ ID NO: 2241129 - RNA, 67 nt, Homo sapiens
uagaugauguuugauaaauaauaauuaccauucauugaguacuuacuauuugcuaagcguugcucua

SEQ ID NO: 2241130 - RNA, 104 nt, Homo sapiens
auggccauucuugcaggaguaaagugguagcucauugugguuuuaauuuuuauuucccugaugauuagugacguugagcacuguuucacauguuuguuggcugu

SEQ ID NO: 2241131 - RNA, 116 nt, Homo sapiens
aauccucauauacuaugauucuuugggugugaaaaggcauggaaaauggaaugccuggaacucuagguuuucagccccagccuaggcaacacucauuggguuuacaccuuaggauu

SEQ ID NO: 2241132 - RNA, 78 nt, Homo sapiens
uucaguuuccguguaguugagcaguuuugagugagaugcuuaauccugaguucuaguuugauugcacuguggucugag

SEQ ID NO: 2241133 - RNA, 58 nt, Homo sapiens
acaguacucagauguuguagggagugucauacaauggccagcacgcacaugagacugu

SEQ ID NO: 2241134 - RNA, 55 nt, Homo sapiens
uugagauguagucuugcccugucacccaagguggagugcagugacacaaucucag

SEQ ID NO: 2241135 - RNA, 77 nt, Homo sapiens
aucaccacccuaucagauguccagagauccauuugccuuuuugcggucuuaugaacaguuguauggggaguggugau

SEQ ID NO: 2241136 - RNA, 81 nt, Homo sapiens
cugcaccaccucuccuccagcuaguauaagcauggagugagaagcugugugccuaguggaaggagagcaaagugagugugg

SEQ ID NO: 2241137 - RNA, 92 nt, Homo sapiens
gcaggagaauugcuugaacccaggaggcagaaguugcagugagccaaagaucgcaucauugcacuccagccugggugacagagcgagacugc

SEQ ID NO: 2241138 - RNA, 80 nt, Homo sapiens
uguuaugggaaauggcaaguucuaaugauuagaauagcguuuuacuuuaauuaaugaacuguggcaggaagcccaaggca

SEQ ID NO: 2241139 - RNA, 100 nt, Homo sapiens
guuggccaggcuggucucaaacuucugaccucaggugauccacccaccuuggccucccaaaguccuggguuacaggugugagccaccacgcccagccaau

SEQ ID NO: 2241140 - RNA, 83 nt, Homo sapiens
uucugguuucucuggugaugaacaggaccauaaugcuccaaagagcuuaugucuuuuguguucagcuaccagggcagguagag

SEQ ID NO: 2241141 - RNA, 94 nt, Homo sapiens
caaagaggccauggauuacugugauauaucuacuucagggaaacuuuacaauucugaaagagcauguaacacaguaacccacaguuuuucuuug

SEQ ID NO: 2241142 - RNA, 66 nt, Homo sapiens
augagauuuggguggggacacagagccaaaacauaucauuuuguuucuggccccucccaaucucau

SEQ ID NO: 2241143 - RNA, 65 nt, Homo sapiens
uggccccaugauucaauuaccuuucacugggacccucccaugauacguaggaauuaugggagcua

SEQ ID NO: 2241144 - RNA, 80 nt, Homo sapiens
uuguacaaaugguugguuuccuuccugcuuaacugugcaaacaagaagagcuaaaggagaaaccacaugaccagguauga

SEQ ID NO: 2241145 - RNA, 60 nt, Homo sapiens
ggguaaggaagaugggccaugaugcagaauuguuguauuacacuuuagugucuuccaccc

SEQ ID NO: 2241146 - RNA, 77 nt, Homo sapiens
uagcuuauucacaggugugggacaaaggacagacaaaacucaaaaucguccuucugugcucaccugagaaaaugcua

SEQ ID NO: 2241147 - RNA, 55 nt, Homo sapiens
accuucagaacugugggcaguaaauguuuguuguuuaagccacacagucuaaggu

SEQ ID NO: 2241148 - RNA, 74 nt, Homo sapiens
uucuugguggaaauauuuuuuacuucauucucuauguaguagcagaaaauauuuuauaugaccacacacaggaa

SEQ ID NO: 2241149 - RNA, 64 nt, Homo sapiens
aggccuagguucucaaaccagcgucaccacuuacgaguucugugacuuugagcaacuugugccu

SEQ ID NO: 2241150 - RNA, 116 nt, Homo sapiens
ugucuuuuucuuuauaaauuaccagucucagguaugucuuuaucagaaaugugagaacagacuaauaugagggcauacucagugaggugaagaguuugugcaaaggcagagaggca

SEQ ID NO: 2241151 - RNA, 64 nt, Homo sapiens
ucuccugaaguuuaugaaaacugguugucuuugaggaguggaaugguuuuugaggcacagggga

SEQ ID NO: 2241152 - RNA, 95 nt, Homo sapiens
cuguuauuaauuaauugauugauuuugaggcagggucuuacucucauauauuuuuucuuggcugauauuauuuaauguaauugauugauugacag

SEQ ID NO: 2241153 - RNA, 94 nt, Homo sapiens
uggaaguguauauuuguuuggaaucccagaucucagagucuucagcuaacaccuacugacacugcaacuauucacaggcaauauguacauucua

SEQ ID NO: 2241154 - RNA, 102 nt, Homo sapiens
aaugguaaaaucuuaacaacuaugguuuaguuaauaguauuguaccaaugcuaucaucuuaguuuugaucacuguacuaugacuauguaggauauuaacauu

SEQ ID NO: 2241155 - RNA, 88 nt, Homo sapiens
gcauuagauucucauaggagugugaacccuaucgugaacugugcaugugcgggauuuagguugcaugcuccuaaugagaaucuaaugc

SEQ ID NO: 2241156 - RNA, 60 nt, Homo sapiens
accgugguguccaugcauaaugguggccacaugcaauuauaugugucuaggagcuauggu

SEQ ID NO: 2241157 - RNA, 77 nt, Homo sapiens
agguguuuacaguaggauuuucagggucuucaaucugucauauugcuagacauagacuuucuacugugucaucacuu

SEQ ID NO: 2241158 - RNA, 130 nt, Homo sapiens
cuggcccuggggcauuauacucucucuugguguauuaguccauucuuaggcugcuaauaaagauauaucugagacuggguaauguauaaagaaaaagagguuuaauggacucacuguuacauauggcugg

SEQ ID NO: 2241159 - RNA, 79 nt, Homo sapiens
ucuuuccuguauaaucgggccugauccucagauaccuaugguacaaagauggugauuagucccauuuuacaggugaaga

SEQ ID NO: 2241160 - RNA, 128 nt, Homo sapiens
auuuauaucccccucuccacuuuucaugcuacuuauuuguggaagaaaucagguuauuuguccuguagaguuuugcagucuagauuuugcugaauuuuucccuagcaagcauacucagauggaaaaau

SEQ ID NO: 2241161 - RNA, 78 nt, Homo sapiens
uuaaguaacagaaacuuauuuuaucacaguucaguucuggaagugaaaagucuaagauuaagguucuggaaaacuugg

SEQ ID NO: 2241162 - RNA, 94 nt, Homo sapiens
uuaugguuauugacucugccaucaguaauucucucacguugugauuccacaguguuccuuuguugugacuggcaaagccacauaauagcuauaa

SEQ ID NO: 2241163 - RNA, 76 nt, Homo sapiens
uuguuuucaaucagccuauguugugcuuuaaagugucuauuuuuauaaggcacuacuuuaggcuuucaaaaaauag

SEQ ID NO: 2241164 - RNA, 97 nt, Homo sapiens
uugcaaugugagaaguacaugagauuugggagggggcagggguggaaugauaugauuuggauuuguguccccacccaaaucucauguugaauuguaa

SEQ ID NO: 2241165 - RNA, 72 nt, Homo sapiens
cccuucccaauaagugguucuagaauugaguauccuaaguuaggauaaucucuggaccauuguccaagaggg

SEQ ID NO: 2241166 - RNA, 65 nt, Homo sapiens
ggagauccacuguguuuguguugaggauucauuacacaugacucaguagaaaauacauggacuuu

SEQ ID NO: 2241167 - RNA, 120 nt, Homo sapiens
uuuguuuguuuguuuguuuuaagugauuucuaguaaagaaguacuuuuucugccauuuugaaacagguaagucucuaauuaugaauuuaaaacuugaagacauugauagauaugaacaaa

SEQ ID NO: 2241168 - RNA, 97 nt, Homo sapiens
gggaggagaaucacuugaaccugggaggcggagguugcagugagccaagacuaggucacugcacuccagccuuuaugacagggcgagacuccaucuc

SEQ ID NO: 2241169 - RNA, 57 nt, Homo sapiens
uaggaggguagucucagccagugaugcagccuggcuucuuggcagaguugcccccua

SEQ ID NO: 2241170 - RNA, 59 nt, Homo sapiens
gggagucaguagagcuauugucauucugaagucuuauugaaauggcuuuuccuguuccc

SEQ ID NO: 2241171 - RNA, 101 nt, Homo sapiens
cucagacuccagcaugcaucagaaucaccuggaggugaucacuuguuaaaaugcgcaucgcugggucccaccuccagaguuucucaugcuggaagucuggg

SEQ ID NO: 2241172 - RNA, 80 nt, Homo sapiens
uuuguaugugcauuguaaauuuugaugucauuaaauaacaaaacuaagauauuucagauagugauaauagcauguauaga

SEQ ID NO: 2241173 - RNA, 64 nt, Homo sapiens
cucccuugcccuucugccaaucaacccacauccauccagcauuggaggcaggacagggcaggag

SEQ ID NO: 2241174 - RNA, 94 nt, Homo sapiens
uaugaggacaugaaauuugggaggggccaaggcuggaaagauaugguuuggcuuuguccccacccaaaugucaucuugaauuguaguucccaua

SEQ ID NO: 2241175 - RNA, 92 nt, Homo sapiens
ucacuuguuaaaaugagcuaagugacuuguuaaagguugugugaccuuguuaaagaucacuuaacagucacuuagcucauuuuaauaaguga

SEQ ID NO: 2241176 - RNA, 82 nt, Homo sapiens
uuauucagucucggguaugucuuuauagcaguguggaaauguacuaauucaccagcuaaaaagaguauguuuggacuaguag

SEQ ID NO: 2241177 - RNA, 65 nt, Homo sapiens
cuaucucaccaaccucaguagcaucuguuaaaaaauaacagaugcuggcaagguugcagagaaag

SEQ ID NO: 2241178 - RNA, 90 nt, Homo sapiens
ccaaguuugcuggagccauguuuucucuaauguccccacagaacagugguugguaggauggcggagacauggacuucagagaguucuugg

SEQ ID NO: 2241179 - RNA, 75 nt, Homo sapiens
ggaagcagcugugcacaucuggcggcccgagccugucgucuggggucugccgucugagguggcgggacugcuucu

SEQ ID NO: 2241180 - RNA, 76 nt, Homo sapiens
uuucacuggaucaguuacccaacugucuauaucaguaugaauuuggaaugugacugauaauauuaguucagugaga

SEQ ID NO: 2241181 - RNA, 56 nt, Homo sapiens
guuucaggcaccauugucauugauaacaucuuaucaggagacaggguuuuugagau

SEQ ID NO: 2241182 - RNA, 87 nt, Homo sapiens
guugaaagugccaacugguuucuuuuaguuguguaugaucauuaauaggguaaaauaaacuaaagaaggaacuguucaauuuucaac

SEQ ID NO: 2241183 - RNA, 64 nt, Homo sapiens
auugugaauagugcugcaauaaacauacgugugcaugugucuucauagcagcaugauuuauagu

SEQ ID NO: 2241184 - RNA, 55 nt, Homo sapiens
guuggaauuacaggccugagccacugcgacuggccccauggcuuauaauuuuaau

SEQ ID NO: 2241185 - RNA, 129 nt, Homo sapiens
uagcuauacugguuuacacauaugagaaacgggagcuguuuagagccugaucaggaauauuugaaauuauuugaaaaaugacuagggcucuaaacagcucccauuucucacguauguaaaccagugcua

SEQ ID NO: 2241186 - RNA, 76 nt, Homo sapiens
aucuuuaacaguguagaggccuauugguucagaguguucaauagaauuccccaagcuacuucacacuaguuaagau

SEQ ID NO: 2241187 - RNA, 91 nt, Homo sapiens
ggguuacccuuggcuuggaugaagagaugguaguugccagggcauccauuccagggcaacaucagucuucaguggcaagccaaugagaucc

SEQ ID NO: 2241188 - RNA, 90 nt, Homo sapiens
aaaugagaaugucuuccauuuggcacuucacugaggcaucccaagguaccuuagggcacuuccaguggaguaaauggacaauuaguauuu

SEQ ID NO: 2241189 - RNA, 65 nt, Homo sapiens
ucaggugcaguggcucaugcuuguaaucccagcacuuugggaggccaaggcaggugaccacuuga

SEQ ID NO: 2241190 - RNA, 72 nt, Homo sapiens
cuuaggaguauggcucaauucuuucccugaaauucuuauuugauuuagcaagauugagccgucuuccaugag

SEQ ID NO: 2241191 - RNA, 59 nt, Homo sapiens
uggagagcacugucucauuuuggaaaauuaucuauuucugaaaugugcacuguuuucca

SEQ ID NO: 2241192 - RNA, 87 nt, Homo sapiens
cugcugaagggagaagaauuugggauuugaguuggaagucauguggcccuucuguacuuccguaccuaaaguuuuccccauuaguag

SEQ ID NO: 2241193 - RNA, 78 nt, Homo sapiens
cugcucgggcccuagcuucuagaacucuuuucagcucugcucugcugagcucagagugcaaagguuggggcuggacag

SEQ ID NO: 2241194 - RNA, 57 nt, Homo sapiens
ugguuucucaaaucugugucacugaccaggacucuuaaugaccagggacagaaacca

SEQ ID NO: 2241195 - RNA, 62 nt, Homo sapiens
gcacaaggguucaguuaaauaaauuuuauaggaggccauugauuugcacugagcuccugugc

SEQ ID NO: 2241196 - RNA, 64 nt, Homo sapiens
acauuuggauuguuucuagauuggggcuuucacaaagagugcuacuauggacaguccagggugu

SEQ ID NO: 2241197 - RNA, 87 nt, Homo sapiens
agggaagauugugcauauagcucuggcuggaugacucgguguauuuauggauucaaagucaguagcaugaacaagucaauuuuccuu

SEQ ID NO: 2241198 - RNA, 74 nt, Homo sapiens
guauaacuaaguuauugguauguguucuaaaauuaugggaaacuccuauaaucaugauaugacuuaguguaugc

SEQ ID NO: 2241199 - RNA, 56 nt, Homo sapiens
acuccucucugagaccuggagcugguaccugugaaagcccagugucagagaagggu

SEQ ID NO: 2241200 - RNA, 89 nt, Homo sapiens
aaggcauaggcaugcugugauauuuccucaugauuagauucagcuuacaaaucuuuggcgggaauaucacaggagugacauaugaccuu

SEQ ID NO: 2241201 - RNA, 129 nt, Homo sapiens
agaaaauaaaguaucaagguaacaauuagcaugaugacuggaacggcacuuuacaucuuaauauuaacagugaauguaaauugcuguuccagucaucaugcuaauuguuaccuugauacuuuauuuucu

SEQ ID NO: 2241202 - RNA, 58 nt, Homo sapiens
ugaaauggaaagaguguagacuuugggcacagaagucugaguuuuuaauuuuauuuca

SEQ ID NO: 2241203 - RNA, 61 nt, Homo sapiens
aaugugucagaaucuagaggcugcuagaaggaaauuagcauggacuaauuuugacuacguu

SEQ ID NO: 2241204 - RNA, 61 nt, Homo sapiens
gugagacugaguuucgcucuugucgcccgggcuggagcgcaauggugugaucucggcuuac

SEQ ID NO: 2241205 - RNA, 57 nt, Homo sapiens
agcuacuguuagucuaguuaggaaaucaaggaauccagcacugagauggcagugguu

SEQ ID NO: 2241206 - RNA, 69 nt, Homo sapiens
cagcuucccugugggcuggugcuccagggucugggugaaccgcugagggcaguggcuucagggaggcug

SEQ ID NO: 2241207 - RNA, 58 nt, Homo sapiens
uucuuuugagcauuuauugugugcagagaauuuugccagaugcaguguucaacaagaa

SEQ ID NO: 2241208 - RNA, 80 nt, Homo sapiens
uuugaaaguuugguuguugcugggccauugcaauuaaguaauuuucugcuaacacagcaccaguauaauuagcuuuuaaa

SEQ ID NO: 2241209 - RNA, 68 nt, Homo sapiens
cccuuacuuuacaggugaaguuaugaagcuauugugauacucuauugccucuuuuguaaaaguggggg

SEQ ID NO: 2241210 - RNA, 58 nt, Homo sapiens
uuaaaguggugggauuccaggcaugagccaccaagcucagucuucucuacuauuuuaa

SEQ ID NO: 2241211 - RNA, 95 nt, Homo sapiens
ugcacauucugugauuuccaagggucccaguggaaccuccaagcuguaaaacauggaguuuggagucauggaggcagagggaguuucuuggugca

SEQ ID NO: 2241212 - RNA, 77 nt, Homo sapiens
gggcuuguagaaacuugcacauucccaggauuccaaucuuugcgaugagacugguaauguguagggcucuagagucc

SEQ ID NO: 2241213 - RNA, 127 nt, Homo sapiens
cauuugcuugguaaaucuuucuccaucccuuuauuuugagccuaugugugucacugcacgucagaugggucuccugaauacagcacacugaugggucuugacucuuuauccaauuugccagucugug

SEQ ID NO: 2241214 - RNA, 129 nt, Homo sapiens
ugcuugaaaagaccacgcucgagggaaagacucagaaaucucacaaacuggaagaaguuuaauggcauccauagaugccaagaacauuuucuguuuugcaguucauuccugguaaguaaaauauuuuua

SEQ ID NO: 2241215 - RNA, 79 nt, Homo sapiens
ugguuagcauaccuuguagugcuauuugauaguaucccauguagagaaugcacuuggcauuugagguguauucugacca

SEQ ID NO: 2241216 - RNA, 59 nt, Homo sapiens
uugauguugaggacauaaaccuuaggaaaugaucccuuccuguguguucuuaauuucaa

SEQ ID NO: 2241217 - RNA, 86 nt, Homo sapiens
ggucagagguuugcuugcacagugguuuagagccuggacuggccacucagccaaggcucaaauuuugugucuggcacuuucuggcu

SEQ ID NO: 2241218 - RNA, 71 nt, Homo sapiens
gaacuaauagaggacugaggugaucuuuuucggcuuuuugcuuaaaauguugcggauccuuuguuuuguuu

SEQ ID NO: 2241219 - RNA, 61 nt, Homo sapiens
gugaaggcagaggggcacauggagucgauuacacacuccacaguaaggacccugccuuuac

SEQ ID NO: 2241220 - RNA, 94 nt, Homo sapiens
cccaaaccagacacuuggaucuagagcacuguggguccaaauaucagucugaugugccugagaaacagugcuuguccuguggguauggguuggg

SEQ ID NO: 2241221 - RNA, 76 nt, Homo sapiens
aguuuaaaauguauggauauuuuuugaacauagagccuacacucaaguuuuauguaauguucauucauaaagagcu

SEQ ID NO: 2241222 - RNA, 87 nt, Homo sapiens
cuucauauggguucuuauguccuuuggacacaguuccuuaauuuugagcaguuguuuuaugacauaagauauuccaugcucaugagg

SEQ ID NO: 2241223 - RNA, 62 nt, Homo sapiens
uguguguauuugagauauugugaaauauauauuugguuuucaucaauacuucuuggcauaca

SEQ ID NO: 2241224 - RNA, 60 nt, Homo sapiens
uauagcaugggguuaaggacuugggugcuggaacuagguccacuuacuacuccuguuaug

SEQ ID NO: 2241225 - RNA, 88 nt, Homo sapiens
uagauuugugauuuuuaaaauccaucucuuggggcauugguccauauaauccaaugcacccagaugaauggauaaaaucaaguaucug

SEQ ID NO: 2241226 - RNA, 65 nt, Homo sapiens
aaagaucaucauagagggcaugagaaccaaauuauaauggacaucauaugaucagugaugacuuu

SEQ ID NO: 2241227 - RNA, 55 nt, Homo sapiens
gucacugugaggaggggccagggggccacgucccuuagcuccagacccacaugac

SEQ ID NO: 2241228 - RNA, 116 nt, Homo sapiens
cugagcauacuggugugcaccuguagucccaccuacuuggggacugagaugggaggauaacuugagcccuggagguggaggcugcagugagccaugaucauaccacugugcuccag

SEQ ID NO: 2241229 - RNA, 73 nt, Homo sapiens
ccugggaucuggagaggaggggcuucacaaggucaugccgaucuaagggacgcccccuucucucuacaccagg

SEQ ID NO: 2241230 - RNA, 72 nt, Homo sapiens
agucauuaagaguacaaaauguagauucagacuaccuggguucaaaucuuggcucuuacuugcauuguggcu

SEQ ID NO: 2241231 - RNA, 93 nt, Homo sapiens
gcuaagcuuaagaauuguaugugagcuauguucuucuuguuuuuaaaaaauuguuuugaguacaguaaaggcuaguuuauguugaagcuuggu

SEQ ID NO: 2241232 - RNA, 70 nt, Homo sapiens
guugccuagccuggagugcaguggugcgaucucagaucacugcaaccucugccuccuggguucaagcgau

SEQ ID NO: 2241233 - RNA, 103 nt, Homo sapiens
gauagaaaauguuuaagacgauggcuggcacaguuaagugcuaccuaaguguaagcacuugccacuugcugcugcuacuauuauuguuauugaaauuauuauu

SEQ ID NO: 2241234 - RNA, 73 nt, Homo sapiens
gauguuguaagauaccccacucucggugcuguugaccccauagauggcucugcaggugaggguagguggcauc

SEQ ID NO: 2241235 - RNA, 59 nt, Homo sapiens
aaugcauggagucuuucacaaguagcaagcaguauagguaacuggacucucuaugcauu

SEQ ID NO: 2241236 - RNA, 81 nt, Homo sapiens
uccaguucucuucuacuaaauugugugugacuugaugaucccuucaccuuguaggaccugguuuguaagagauggacugga

SEQ ID NO: 2241237 - RNA, 84 nt, Homo sapiens
ggagaaucgccugaccccaggaggcagagguugcagugagcugagauugcaccacugcuagccuggguaacagagcaagacucc

SEQ ID NO: 2241238 - RNA, 77 nt, Homo sapiens
gccuuguaguauaguuugaagucagguagcaugaugccuccagcuuuguucuuuuggcuuaagauugacugcaaggc

SEQ ID NO: 2241239 - RNA, 62 nt, Homo sapiens
guuagcuguuggugggaagucagagacucacuguuucugcucaacaaacaccagcaguugau

SEQ ID NO: 2241240 - RNA, 79 nt, Homo sapiens
aacuugucauuguucacaguacucccuggaauuaaacccccaggguuuuagcugauuccuauugugaguaguuuagguu

SEQ ID NO: 2241241 - RNA, 76 nt, Homo sapiens
uggaauccagauaauguuuauccagaggaguuagaagacucuaaauuaccaacugggaacauuauugucuuuucua

SEQ ID NO: 2241242 - RNA, 114 nt, Homo sapiens
ucagauggugaugcuauuggcugugauuaugguuaugauucaaguuggcaaugagacucgcaagaugcaauuggcuuguguuuacuguaguuacuguuuuaguucauuuucuga

SEQ ID NO: 2241243 - RNA, 61 nt, Homo sapiens
uuccuugugcaggguacuugccagcccuuuacaguauggcagcuguguccuucguaaggaa

SEQ ID NO: 2241244 - RNA, 57 nt, Homo sapiens
uauuauagcacauuguaagucucacucaagagagcugagcuaggugaggcuguaaug

SEQ ID NO: 2241245 - RNA, 80 nt, Homo sapiens
ucuuguuaguaaucaucugagggcagaaauccuguguuuacauucgcuugcuguuucccuucagguaauuacuucuuaga

SEQ ID NO: 2241246 - RNA, 66 nt, Homo sapiens
uuaagccuaucugugucucugcacgugagauggguuuccugaaugcagcacacugaugggucuuga

SEQ ID NO: 2241247 - RNA, 81 nt, Homo sapiens
uaaggugacuaaagugaggauggcaguagguuuggauuccuuauuuacuuacuucuaguuugucacuucucagucaccuug

SEQ ID NO: 2241248 - RNA, 92 nt, Homo sapiens
guggauauggaggcugccuuauuaaauaggcuggugaaaucaguauaucaaagggauaucugcauucccauguuuauugcagcacuauucac

SEQ ID NO: 2241249 - RNA, 114 nt, Homo sapiens
accuacauuggacuguaacauuagugauaaauagaucuguaucuugcugguuaagucacugagauguaagaauuuauuuguuacugaagaacauccuagcccaaaauuguaggu

SEQ ID NO: 2241250 - RNA, 89 nt, Homo sapiens
uaagcucuaugagaacaggaauuucuguugguguugugcauugcuauaucaccagcaccaauaacaguuucuagcauauacuaggcuua

SEQ ID NO: 2241251 - RNA, 65 nt, Homo sapiens
acucacgauuggaguuaguacaacucauuuuuuauaaaaucagcacacugugcuuuccagugagu

SEQ ID NO: 2241252 - RNA, 107 nt, Homo sapiens
caagauaucccuguaaagcauugcuaugguuuuggaauccugcagauaaaauggaaugucuucagguguuugaaaaucugggucauaugucucuacuugggaacuug

SEQ ID NO: 2241253 - RNA, 66 nt, Homo sapiens
gacauauaagugaggucauacagcauuugucuuuuuguuuguggcuuaucucauuuagcguauguc

SEQ ID NO: 2241254 - RNA, 60 nt, Homo sapiens
uaaaucuguucuguguagaauuaauggaacauaccuugauauuacucaguaacagauuug

SEQ ID NO: 2241255 - RNA, 70 nt, Homo sapiens
auucaccauuucuugcugaaacaaauaaaccagaauuaacuguguaucuauucagcaaaggaaugggagu

SEQ ID NO: 2241256 - RNA, 60 nt, Homo sapiens
guucauugagauuauuguguuccuuuaguuuuuuuaggugaaaaaaugauuuuagugaau

SEQ ID NO: 2241257 - RNA, 101 nt, Homo sapiens
cgccagagcgaugcauuuaucacagcucaugaaacuacacggacacaucaucauuacccagagugaugguccauaguucaugguaguguucacgcuuggug

SEQ ID NO: 2241258 - RNA, 56 nt, Homo sapiens
guguggcuacuggcgugugugggagaagggacauuucucacgugcagcagccacac

SEQ ID NO: 2241259 - RNA, 73 nt, Homo sapiens
agggaaaaaugacaagaugacuucaguggaaccucuggauccaccuguacuuaagucacuuuguugggucucu

SEQ ID NO: 2241260 - RNA, 59 nt, Homo sapiens
uugagggagcacagauucuuauugccucacuggagagaaacuuagacugugcccuuuaa

SEQ ID NO: 2241261 - RNA, 67 nt, Homo sapiens
aggaagucucucaaaacuggaagggaaagguguuuucuccacaucaauccaguuuuggagacauucu

SEQ ID NO: 2241262 - RNA, 110 nt, Homo sapiens
guuccaguaauguuaguuucgugguagguuaguuagaucauguuuggauaucuggacucauguuuaugaugcuuugauuuauacaacaacaacaaacuuuauugaugaac

SEQ ID NO: 2241263 - RNA, 64 nt, Homo sapiens
aaguagcucucagcagaugggggagccagaagggagauggcuuuccccuggaguggggcugcuu

SEQ ID NO: 2241264 - RNA, 90 nt, Homo sapiens
uccuaauccccauaacuuuugaauauguaugcuuaugugguaaaaacgacauugcagauguguuuaauguuaacaaucuugagauaagga

SEQ ID NO: 2241265 - RNA, 122 nt, Homo sapiens
aauguaguccuccuuaucugagauuuuaguuucugugguuucauuuaccugugaucaaccccaaucugaagacagauaaguacacuacaaugagguauuuucagagagagagagucuacauu

SEQ ID NO: 2241266 - RNA, 59 nt, Homo sapiens
ugagguguauugggggaaauucagccagauaucgggcgaaauucaccccugauauuuca

SEQ ID NO: 2241267 - RNA, 128 nt, Homo sapiens
aggcggcguggauccuacagcuucucguguacggaaaggcgguguggauccuacagcuucucuacugaaagguggcguggauccuacagcuucucguguacggaaaggcggcguggauccuacagcuu

SEQ ID NO: 2241268 - RNA, 74 nt, Homo sapiens
ggacaguuaucuccagugcaaagucaugaucacauaugauugauguuauuagcuugcugcuugaguuacuguuc

SEQ ID NO: 2241269 - RNA, 66 nt, Homo sapiens
gugugguggcacgugcuuguaaucucagccacucgggaggcugaggcaggagaacggcuugaacac

SEQ ID NO: 2241270 - RNA, 76 nt, Homo sapiens
gggcuuuacagagguaguuuaguuuuggggaagggcuauugcuauuaaacuauaaacuaaauuucucccaaaguuc

SEQ ID NO: 2241271 - RNA, 76 nt, Homo sapiens
uucacugagccagacuaagacaaaagugacucuuccucuacccccucucucacauguaaauucuguauucagugaa

SEQ ID NO: 2241272 - RNA, 77 nt, Homo sapiens
aguuuuaucagauuggugcaaaaguaauuuugguuuuugccauuaaugucaauuacuuuugcaccgacuuaauagcu

SEQ ID NO: 2241273 - RNA, 66 nt, Homo sapiens
gccugagcuuuuauacaaguaauuaucuaaugugugauaagauaaugcuggaacuagagggcaggc

SEQ ID NO: 2241274 - RNA, 64 nt, Homo sapiens
auaaauuugggggcaggagacaugauucagcccauaacaaugucccuguuaggcacagauuuau

SEQ ID NO: 2241275 - RNA, 102 nt, Homo sapiens
cauuccuaccuuaaucuucagagauccuugaaauguuuagaaguuuggauuugauaguacauccaaagcugaagcauuucuaguucuuucaagcagggaaug

SEQ ID NO: 2241276 - RNA, 66 nt, Homo sapiens
gcacccaguaagcaugaggcccugggcgcagcacgccuucaggagcugguagucucauugggaugu

SEQ ID NO: 2241277 - RNA, 77 nt, Homo sapiens
cuuuguuauuguaauguuaccaaaugguguuuugccucaaagaguggcaagaaucauggaaagcaugcaauucaaag

SEQ ID NO: 2241278 - RNA, 55 nt, Homo sapiens
uauacacgugugcauauauacauguauguuguguguguguauguguaugugugua

SEQ ID NO: 2241279 - RNA, 84 nt, Homo sapiens
agaagugcuaaaugcaugaggcgaugugcuaauuaccuugauuugaucaccccauauugucuauguguauuggacuaguacucu

SEQ ID NO: 2241280 - RNA, 73 nt, Homo sapiens
auauguguugggcaguuuucuaugcugcaauuuaucgcaagaauagcagcaaagcaggaucugcucacugugu

SEQ ID NO: 2241281 - RNA, 89 nt, Homo sapiens
gaagaaauagcuuauacuggugguucucauaauguggccccuggccuagcagcauaagaaucaccaaggaaucugguuuaaauuuuuuu

SEQ ID NO: 2241282 - RNA, 56 nt, Homo sapiens
uugagauggaguuuugcucuuguugcccaggcuggagugcaauggcaccaucucag

SEQ ID NO: 2241283 - RNA, 56 nt, Homo sapiens
uugagauggaguuuugcucuuguugcccaggcuggagugcaauggcgccaucucgg

SEQ ID NO: 2241284 - RNA, 95 nt, Homo sapiens
augaauggugaaaguguauguaguauaugcuucugacacagucuuuggagagcugauucaaagucuucucaaguaacauauagcuucccaaucgu

SEQ ID NO: 2241285 - RNA, 56 nt, Homo sapiens
cuauucacaauggugaagauauguaaucaacugcaguguccauuaauugugaaugg

SEQ ID NO: 2241286 - RNA, 57 nt, Homo sapiens
uggacaagugcccuccaccucaacaguuuccccugcaaggugaggaggaacuuucca

SEQ ID NO: 2241287 - RNA, 57 nt, Homo sapiens
cugagaaguccugcaguaaggaauccaacuagauuugcuuaaugcagcauuucucag

SEQ ID NO: 2241288 - RNA, 65 nt, Homo sapiens
caaacugacacagacagcugcuuaucaaauccugacacauaacagcauuugugucuaguaguuug

SEQ ID NO: 2241289 - RNA, 66 nt, Homo sapiens
gcuuuucaucagcgugagaugccuuuggucuccaaucaauuguauaucucacuugaauguaaaagc

SEQ ID NO: 2241290 - RNA, 67 nt, Homo sapiens
gcuagggagugucuucauuuuguagaaauaucuuucugauuucuggcggauaaacaucucccuuggc

SEQ ID NO: 2241291 - RNA, 58 nt, Homo sapiens
ucuaaacugucuggaugcuuguggauauucauugaugucugggcauuuaacaguuaga

SEQ ID NO: 2241292 - RNA, 64 nt, Homo sapiens
uggcagaguaauacuggacaggguaucaggagaccuugauucuauuuugaguguugcuuggcua

SEQ ID NO: 2241293 - RNA, 63 nt, Homo sapiens
cuauguguccauguguucucaucauuuagcuccaccugauaagugagaacaugugguauuugg

SEQ ID NO: 2241294 - RNA, 66 nt, Homo sapiens
cagcuguguuauaaacuaccaugggguaaauaugcuaacaauccauuaguacagcagcaccagcug

SEQ ID NO: 2241295 - RNA, 91 nt, Homo sapiens
agaccuccagacacagaguaggcacacaucuacuacaaauaugaauguauguuuguggccucaugugugugcaaacuugucuggaugaucu

SEQ ID NO: 2241296 - RNA, 78 nt, Homo sapiens
uugaaccugaucucauuagcaccuuuagcuuuggcaguauaauuuugagccauguugaaggaaaugggauuuuaucaa

SEQ ID NO: 2241297 - RNA, 63 nt, Homo sapiens
auugcuuaggagcccugaaaucauggcaggaagaucuuguuagaugaaugucucuuaaacaau

SEQ ID NO: 2241298 - RNA, 82 nt, Homo sapiens
gccuuuuacgcacacugcaguaaauugcgucgguucauuuacucacagaacaagcacagacaaugcugcaguuuagaaaggu

SEQ ID NO: 2241299 - RNA, 62 nt, Homo sapiens
agcauuucuacugugucagaaauucucaaacuuuagaguguaacugaaacacagagagggcu

SEQ ID NO: 2241300 - RNA, 62 nt, Homo sapiens
gacugaucuuaucuccugauaccucccuuucccugaggcccuucacaagccaagaucacguc

SEQ ID NO: 2241301 - RNA, 75 nt, Homo sapiens
agcccuuugucagauggauagauugcaaaaacuuucucccauucuguagguugccuauucacucugaugauaguu

SEQ ID NO: 2241302 - RNA, 59 nt, Homo sapiens
cacaugaagacacugagaaccaugugugccuacaugcaacugguuucaguuuuucagug

SEQ ID NO: 2241303 - RNA, 125 nt, Homo sapiens
gacuuuaauucuggcacuauguauggcucucugggucuggguuuguguugccuaugccugcagaugguguagcagccauaaacacagugagcagaacagcaaaucagucaguuuuuggaacaguc

SEQ ID NO: 2241304 - RNA, 62 nt, Homo sapiens
aguauuguagcuuucuguagugcaauauucuagcuauugaacugggguuggguugcgauauu

SEQ ID NO: 2241305 - RNA, 86 nt, Homo sapiens
cuguagccuuguaguauaguuugaagucagguagugugaugccuccagcuuuguucuuuuggcuuaagauugucuuggcaaugcgg

SEQ ID NO: 2241306 - RNA, 71 nt, Homo sapiens
gucauuaugcuccaucuugucaguaaucuucuuguuaaagagcacucguugacaugaugagcaauaauggc

SEQ ID NO: 2241307 - RNA, 79 nt, Homo sapiens
ggaauuuggagcccuucaugggagaaccacagguagauugagucugcuugaaguuuucccaugacaggcuccuaauucu

SEQ ID NO: 2241308 - RNA, 100 nt, Homo sapiens
cugcccaaucucuucucccugcauaguucaccgcugauaccuguuuccccaacuucacuugguagcaaaggaugacuauguaccaggaauugacaugcag

SEQ ID NO: 2241309 - RNA, 73 nt, Homo sapiens
ucugaauggagcuguuuggaugacuuggaggucuuuugugagaaaaggucguccauacagcauuucauaugga

SEQ ID NO: 2241310 - RNA, 74 nt, Homo sapiens
guagauggauuucagauguguagggagcuaugguuugaauguccccuucaaaacacguguugaaauuuaauugc

SEQ ID NO: 2241311 - RNA, 81 nt, Homo sapiens
ucuugggaaguuugcaguagcucuaaggguucaacaagcaaaauaaaacccugugaauauuuaaacuucagucauccagga

SEQ ID NO: 2241312 - RNA, 77 nt, Homo sapiens
ucucauacuuuuauagcaacacucugcucuagcuaccaauuuucugugcuaagcuguauuguguugcuauaaagaga

SEQ ID NO: 2241313 - RNA, 63 nt, Homo sapiens
auggcagcgugaauguggcugaacuuaaaaugcuuguauaacuucgacaucgcacgcuuccau

SEQ ID NO: 2241314 - RNA, 62 nt, Homo sapiens
aaauccauuuguucagcuaugcagaaagaguuuucuucaauauugguugagcgauugaauuu

SEQ ID NO: 2241315 - RNA, 62 nt, Homo sapiens
uuccugagagcuuugaugcacuguuuccuguuguaggaugggcaggcacuggcucucaggga

SEQ ID NO: 2241316 - RNA, 61 nt, Homo sapiens
cuccuagagcacaaaaggccauugugaaucaucccagugcugcacuuauggcucugaggag

SEQ ID NO: 2241317 - RNA, 55 nt, Homo sapiens
agggcagauuguauauucuccacugguuggcacauuagaguauugaauuugcccu

SEQ ID NO: 2241318 - RNA, 70 nt, Homo sapiens
gcagaucucucuucucauugacauguccucacaguaaaugaugacuugaagaaucuaagggagguucugc

SEQ ID NO: 2241319 - RNA, 64 nt, Homo sapiens
cuuuuugcaaauacaacucugaggcugauuuguaagccuguuaacagauuguacuuauaaaaag

SEQ ID NO: 2241320 - RNA, 84 nt, Homo sapiens
aaaagggaaaaguagauacagagagacaaaaauauuauuauguuacauauauguucugugucccuuucgaucuguuuccuuuuu

SEQ ID NO: 2241321 - RNA, 114 nt, Homo sapiens
cugaccaugucuucaggcaggucaugaagaguuagugugagguugaaaauaauggaaauggggaccauuugaccacaacccucucugguucuucauaguccucugaggccucag

SEQ ID NO: 2241322 - RNA, 84 nt, Homo sapiens
uuuguuaaaaauccacauucauggaccaguccuauugaaucagcgcuuuagagguaggacugaguaauuugcauuuuuaacaaa

SEQ ID NO: 2241323 - RNA, 55 nt, Homo sapiens
ccucaaagucaagggaaagcaggucaaaugauuuuguuuagcgcugacauugagg

SEQ ID NO: 2241324 - RNA, 71 nt, Homo sapiens
gggagcucauuagcaauuaaagccugcuuuuuaaaauuccaaaagugguuuuaaucuggugaguggcucuc

SEQ ID NO: 2241325 - RNA, 69 nt, Homo sapiens
agaacguugaagagaaccgcggcuuauugucaaagggaaaaguaaccgcagaguuuucuuucugcuucu

SEQ ID NO: 2241326 - RNA, 66 nt, Homo sapiens
uagaaugccuugggucagccagguguuucuauccuuagaaugcauuagguugcccaggugucucua

SEQ ID NO: 2241327 - RNA, 86 nt, Homo sapiens
ggagguacaggaaggcaagaugagagcccgggcagugacugcugagggucacugauagcuccucuuucaucuucacuuccugcucc

SEQ ID NO: 2241328 - RNA, 73 nt, Homo sapiens
uuacgaauaaugucacaggggguuagccuguguaauaucacaggguguacacccccugugacauuaggaguaa

SEQ ID NO: 2241329 - RNA, 70 nt, Homo sapiens
auacuagaaaagguuuugauccucuuucugaaaacaagauggucucaggaauggaaacuuuugaugguau

SEQ ID NO: 2241330 - RNA, 58 nt, Homo sapiens
gggugagguaugggagaaggggcauagaacuuccauuucuucucugguuguacuaccc

SEQ ID NO: 2241331 - RNA, 120 nt, Homo sapiens
uugaguuguuaggaaggugguuuagauuaggagcauaggauuguuugagauuugaacacugcccguguaagcuuuucuaacagucccaugcuuuugaucaauuauaagauccucccucaa

SEQ ID NO: 2241332 - RNA, 71 nt, Homo sapiens
auuguacuagguccuagggcuuaaaaggugauuaaaacaucaucccuacccuagagagcuuacaguacagu

SEQ ID NO: 2241333 - RNA, 130 nt, Homo sapiens
uuuuaccaauucacuauugaugggcauuuagauuauuuccaaagugugcuauuacaaauaaugcugcaauuaacacauuauauguguaugugcauaccuguguguauuuucaguaguaacuguguugaaa

SEQ ID NO: 2241334 - RNA, 98 nt, Homo sapiens
gaggcaggagaaucacuugaaccugcgaggcggagguugcaguaagccgagacugugccacugcacuccggccuggcaacagagugagacuccgucuc

SEQ ID NO: 2241335 - RNA, 90 nt, Homo sapiens
ggcauuagauucucauaaggagugcacaaccuagaucccucgcauucucaguucacaauagaguuugcacuccuaugagaaucuaauacc

SEQ ID NO: 2241336 - RNA, 71 nt, Homo sapiens
gccuuuggagucugacuuauaggaaccuucuggguucugcccagguuacuagcaggucagaaucuuggggc

SEQ ID NO: 2241337 - RNA, 101 nt, Homo sapiens
gccuugggauccugggcaagccacuucuuuucacuguggagaguaaaaacauuuucacuguaaaaugaagaggguugaacuagacucuggucaccaaaggc

SEQ ID NO: 2241338 - RNA, 73 nt, Homo sapiens
aaccugccaauuauaguugugaauuuuaucaugauguuuugguugauaaaggaccacauauaugguggcgguu

SEQ ID NO: 2241339 - RNA, 108 nt, Homo sapiens
agcucagccucaguagaacagagcaccaaguagauucauaaaguuuccaacucugggcccuggcuccuggauggcauuucuggaucugcccugggcuggggcagagcu

SEQ ID NO: 2241340 - RNA, 78 nt, Homo sapiens
aaguggauugguuaauuuuuuuacuuuuuguuaccacaaaguucuugcugaaggauuauauuguuuaucaauccauuu

SEQ ID NO: 2241341 - RNA, 57 nt, Homo sapiens
uuacuguauagaaucaucuugaaugcuaccagugcuacacgggaugcuauaugguga

SEQ ID NO: 2241342 - RNA, 55 nt, Homo sapiens
cauugcacuuagacaacuuuuguuucaaguguguguugaggguauaagugcaaug

SEQ ID NO: 2241343 - RNA, 77 nt, Homo sapiens
gggaaccugcucauuuugcguugaauuccgucuguauuuuucuagauaugugacuucaugcaaggcuuuauauuccc

SEQ ID NO: 2241344 - RNA, 65 nt, Homo sapiens
acuuaacaguggucugugguaucugaggaaacuuuagaugaacagaaagccacuguuuuaugagu

SEQ ID NO: 2241345 - RNA, 90 nt, Homo sapiens
cagaguuuuccauuuuguaucuauuuauguuuggcauuuaauuguugcugaaaacuuuauguaaguacaugcuagauggaauggcuucug

SEQ ID NO: 2241346 - RNA, 89 nt, Homo sapiens
ggcugggucaaaugguauuucuaguucuagauccuugaggaaucaccacacugucuuccacaaugguugaacuaguuuacagacccacc

SEQ ID NO: 2241347 - RNA, 107 nt, Homo sapiens
agucaucuuuacaggcggauuucuuaguguuuuucauuggcagaggcaggcuuuuccuugugugaccucaaugaaaguauauuugaucauccuuagaggagaugacu

SEQ ID NO: 2241348 - RNA, 58 nt, Homo sapiens
auccguggcacacugugauguguuauuacucaaauuaugaacagugcuggcaugagau

SEQ ID NO: 2241349 - RNA, 82 nt, Homo sapiens
aguucuaggguacaugugcacaacgugcagguuuguuacauauguauagauuugucauguuggugugcuguacccauuaacu

SEQ ID NO: 2241350 - RNA, 69 nt, Homo sapiens
ugugccaugaggcucugauaugugcccugcacuguggggggugccaaaaauuagagcuacauggcuaca

SEQ ID NO: 2241351 - RNA, 55 nt, Homo sapiens
cauacaugugcuugucuuaugccuuuaaagcacuguauaugaagagucaugugug

SEQ ID NO: 2241352 - RNA, 55 nt, Homo sapiens
gcauaaucagaguuaguucaguguuaauuauuuugagagaugaacucugauaugu

SEQ ID NO: 2241353 - RNA, 65 nt, Homo sapiens
gaggaaucaaagccaugcucaguuuucaguccccuugguugaggaaaggguuggcuugaccccuc

SEQ ID NO: 2241354 - RNA, 56 nt, Homo sapiens
auguaugccuauauagaaguauggaaauauauauuuauaaauguauagguguacau

SEQ ID NO: 2241355 - RNA, 81 nt, Homo sapiens
ucacucauucauucccugagcaucuguugagcccuugcuuugugcugggcuuugagcuaguugcuggggguacaaugguga

SEQ ID NO: 2241356 - RNA, 67 nt, Homo sapiens
uucuuaucaauauugucauuuauaacuguguagaugaucuauuguucaucuggugacuuggugagaa

SEQ ID NO: 2241357 - RNA, 90 nt, Homo sapiens
uguuauauuugcaugggcuacauuuuuucauccugucacuuucaaucuacaugugucauugaaucuaaaaugagucucuuguagacagca

SEQ ID NO: 2241358 - RNA, 68 nt, Homo sapiens
ggcaggauuuggcaguauaaugcuuuggggucagguacucagaggcaucuguuuuguuguuguuuguu

SEQ ID NO: 2241359 - RNA, 65 nt, Homo sapiens
uuguccuaauuagguaaagcauacaaaaauuucaacacagaauugugauuauuuaaauaggacag

SEQ ID NO: 2241360 - RNA, 117 nt, Homo sapiens
gcugaauaagcuaggcaaugcaguugccauuggggugagguaggugaagaaugcacggaaccuuccuguacguuuauuuauuuauuuuucuuugcaacugcauugacugcugacagc

SEQ ID NO: 2241361 - RNA, 64 nt, Homo sapiens
uucaguuugccaguauuuuauugaggauuuucacaucaauguucauucgggauauuggccugaa

SEQ ID NO: 2241362 - RNA, 69 nt, Homo sapiens
acagccuggcauucagggccucuaccagucucugcaucuuggugguaguggucccccagucccagcugu

SEQ ID NO: 2241363 - RNA, 74 nt, Homo sapiens
gucccagagcuguguuuuaacuuuuuauauuuuacucaaguauccaauuaagaauuaagcauggguuuuggggc

SEQ ID NO: 2241364 - RNA, 63 nt, Homo sapiens
aaucauggaguauuuguccuugugugaauggcuuuuuucacucaacauaaugucuucaugguu

SEQ ID NO: 2241365 - RNA, 93 nt, Homo sapiens
uccucccaggauuucuuucuugugggugcccuuuuugcagcguaaaaaccccaggggaagagguagcagucacaaaagaaauccuagggagga

SEQ ID NO: 2241366 - RNA, 81 nt, Homo sapiens
ucagauuuuaucguauaauugucaaagugccuggaugauauugauucuuugguauugguugagauuaacuuugugaucugg

SEQ ID NO: 2241367 - RNA, 64 nt, Homo sapiens
gauuuaggagugaugcagaguauaaaaucucaaauuaaaagugaagcugagucauuccuggguc

SEQ ID NO: 2241368 - RNA, 64 nt, Homo sapiens
ucucugucucuuucuguuuaucuuugucuucuguuuuagacaaugagcuccucaaggucagaga

SEQ ID NO: 2241369 - RNA, 60 nt, Homo sapiens
auuauuaguuguugaaugaaguggccuauugaugucaauuuuauucaguugauugauggu

SEQ ID NO: 2241370 - RNA, 74 nt, Homo sapiens
cucugccucucaagaugcugggauuacaggcaugagccacuaugcccauuguaauugguguuuuugaagaagag

SEQ ID NO: 2241371 - RNA, 57 nt, Homo sapiens
aaaguggugugaguauguaucuaagucaccugacauugugauucacggcaccgcuuu

SEQ ID NO: 2241372 - RNA, 118 nt, Homo sapiens
gggacgagucgguuuggcuccccgggccucgguuuccccacccguacaaugguagugaucguccguucuccacugagcaggugggaggccuuggccccggccucgcaccguucguccc

SEQ ID NO: 2241373 - RNA, 63 nt, Homo sapiens
guuuuuggggucacuauuaccgaaaggguuugacgggccccugaggugauguaccuuaaaaac

SEQ ID NO: 2241374 - RNA, 70 nt, Homo sapiens
uugaggaucauuguuuucggagcccuaaaaaccuggagugggcagcagagccugaggacagugacuuuaa

SEQ ID NO: 2241375 - RNA, 116 nt, Homo sapiens
gcauauucugauacaagaaaacggcugaaguuuaugguacaggaaugcuguucucagucucucuauuaugaagagcugcauucguaucauauugugccuuaugcuucggagaaugc

SEQ ID NO: 2241376 - RNA, 64 nt, Homo sapiens
auugaaauugaugaaauucuugcauuccagugcuucaaagaccuggacuuucaucaguuuuaau

SEQ ID NO: 2241377 - RNA, 55 nt, Homo sapiens
ucuaaaaccuucuaauugucuacuuacaaggucuagacacuuggaagguuuuaga

SEQ ID NO: 2241378 - RNA, 55 nt, Homo sapiens
ggugccaggagagggcaggagggcuacagccuuucaccugcuguucuuuugcacc

SEQ ID NO: 2241379 - RNA, 82 nt, Homo sapiens
gugauagucucaugucuaauuugagguuccagaagcccuuuaaaggguggaugagcugcacaaauggaugugagggaguuac

SEQ ID NO: 2241380 - RNA, 87 nt, Homo sapiens
uuacauggaugaguugaauaguggugaaaguuugagauuuuagugcaccgucucaguuguuaccacuuuuaugaaaauccuauguga

SEQ ID NO: 2241381 - RNA, 58 nt, Homo sapiens
gaucuuggagugcuugucaguggaagcuugugucucuugugacaugaaacccaagauc

SEQ ID NO: 2241382 - RNA, 63 nt, Homo sapiens
gggguguuguuuuauugguugcagugagcacaugucaauuuuguaacuggagaguaacauucc

SEQ ID NO: 2241383 - RNA, 78 nt, Homo sapiens
gagauuagacuguccagacccuauauaucauaguuacacaagcugaccccaugguauggaaggucuggaggacaucuc

SEQ ID NO: 2241384 - RNA, 100 nt, Homo sapiens
uucucaaaaaaaacugaagcaauggacuaaaauuuggagagcuaagauuuuuagaauuuuagcucauucaauuucagucaaaaacugccacucuugggga

SEQ ID NO: 2241385 - RNA, 82 nt, Homo sapiens
uuggauuccuguuccuuuguuaguuugcugagaaugauggcuuccaacuucauccauguuccugcaaaggacaugaauucaa

SEQ ID NO: 2241386 - RNA, 76 nt, Homo sapiens
gucugguguaugccugauucuguggcuaugaaacauccggaauagacaaauccauagagcuaggaugcagacagau

SEQ ID NO: 2241387 - RNA, 80 nt, Homo sapiens
ugcagccuagggacuugguacucugugucccagcugcuccagcugugacugaaagaggccaauguacagcuugggcugca

SEQ ID NO: 2241388 - RNA, 90 nt, Homo sapiens
cuuccgcuguaauucauuuacugaacacccacuaggugcuaaggaccaagccagguggugguauuucagaaaaugaggacacauuugaag

SEQ ID NO: 2241389 - RNA, 67 nt, Homo sapiens
gaacauggcucuguuuuuuaugcucuauugaaaaugaucaucagaagcagaaacugggcuuguguuc

SEQ ID NO: 2241390 - RNA, 82 nt, Homo sapiens
aaggaagcaugggggaagauucaucccacuuucacuucauucaaguugagaacucaugaaucuuuccaacuucauccuccuu

SEQ ID NO: 2241391 - RNA, 65 nt, Homo sapiens
caugagcaucuuugauaaauuucaugacaauaacugaacuugaaaugucugagauguggcucaug

SEQ ID NO: 2241392 - RNA, 55 nt, Homo sapiens
ucuucaugucuucaaugggggggguaacauauaccuucugagguugcuaugaagg

SEQ ID NO: 2241393 - RNA, 68 nt, Homo sapiens
ggagaugcuguguugcuggcuuaaagauggagaaagagauccaugagccaaggaauacagcagccucc

SEQ ID NO: 2241394 - RNA, 72 nt, Homo sapiens
ggacaugugagauuagcugagauccuuguggcugagguacaguucaacuccucucccuaguuucuuuaguuc

SEQ ID NO: 2241395 - RNA, 57 nt, Homo sapiens
guggcuguuaagugcaauugcuaacuaaauguguagccuguugccuaggcagcucau

SEQ ID NO: 2241396 - RNA, 64 nt, Homo sapiens
gaauggcuuuaagagugucugaauuauuugaguuaucuuuuauuuugccacuuuugagccauuc

SEQ ID NO: 2241397 - RNA, 58 nt, Homo sapiens
gaggcggagguugccaccacugcacuccagcuugggugacauggcgauacuccgucuc

SEQ ID NO: 2241398 - RNA, 84 nt, Homo sapiens
augcuugcaagaaacauauuccacaagcguuuggguaagucauauauuauuugacacuuuggaaauaaauuucuuguuaagugu

SEQ ID NO: 2241399 - RNA, 85 nt, Homo sapiens
gucucuucccaggaggguaugcacacucucccaggaggguaugcacacucucccaggaggguaugcacacucccccuggagggau

SEQ ID NO: 2241400 - RNA, 55 nt, Homo sapiens
guaugguacuuuaugguuagugacaagcagagcacuaccauaugguucaccaugc

SEQ ID NO: 2241401 - RNA, 77 nt, Homo sapiens
ugccuguaaucccuggacuuucggaggcugaugugggaaaaucacuugaguccaggaguuuaagaggagcaugggca

SEQ ID NO: 2241402 - RNA, 70 nt, Homo sapiens
uaccugcagagaaacauuuuguauuuucaauaaauggugcuggaaaaacugaaauauuucucuguaggua

SEQ ID NO: 2241403 - RNA, 93 nt, Homo sapiens
agauaaugucuaagugagugacaaaaacugggccucagacaccagcuauccaauuucagaguccaaauuuuuaguccuuaugcuauguuaucu

SEQ ID NO: 2241404 - RNA, 77 nt, Homo sapiens
gaggaacuagagagaagcugugugaccuucccuaacuucaccugagaaguuacacagugucacuucuaccacacuuc

SEQ ID NO: 2241405 - RNA, 74 nt, Homo sapiens
uaaagugugcgauuuaguggcccuugguacacacacaauggugugcaaccaucaccacugacuccagaacuuua

SEQ ID NO: 2241406 - RNA, 99 nt, Homo sapiens
caacuuucagacuaaaauauauaugcauauuucugaaagauuucauuucucaugaaguguucugugagaugucuauuucagagauguuuuguaagguug

SEQ ID NO: 2241407 - RNA, 56 nt, Homo sapiens
cagacuaggaagaagugaugccuccuuggagaaguccugcauucauccugguguug

SEQ ID NO: 2241408 - RNA, 73 nt, Homo sapiens
uggcuuaguggaaggaacugaguaauuaaaucgaauaugucuaauuacucgugucuuuacugcuucauugcca

SEQ ID NO: 2241409 - RNA, 56 nt, Homo sapiens
ucagguagcauuuuggaaacagcggccucuuuugcauggcuccaaauucugcuuga

SEQ ID NO: 2241410 - RNA, 86 nt, Homo sapiens
ccaauauacuguaacuuacaguggaaguuaaccccauuuugaaaaauuagauuguuuuaauuccauugugaaguugaaaaaauugg

SEQ ID NO: 2241411 - RNA, 59 nt, Homo sapiens
uaagcaguaaaugaagucuugcugucaggaacaguauggcaagaacuauuuccugcuua

SEQ ID NO: 2241412 - RNA, 89 nt, Homo sapiens
uuuguuuuugagaauuuggaauguaguaauuugguuagugaaaguucgagcagugagagaaaccuacauucacauaucucaaaaucaaa

SEQ ID NO: 2241413 - RNA, 61 nt, Homo sapiens
cuuauuagaaagaaaagacaugguggguuuuuuccccuuuauucuuugcuuuucuaagagg

SEQ ID NO: 2241414 - RNA, 94 nt, Homo sapiens
gguauacauguuagugggauaauuuuuggugcuguuugggcugugauccaguagacggugcuuaagaguaaucgccaguagccaggcuaauacc

SEQ ID NO: 2241415 - RNA, 64 nt, Homo sapiens
ucuuucuuagaugaccuauuuagaguguaauuaucuacucauucuguugguucuuugaggagga

SEQ ID NO: 2241416 - RNA, 130 nt, Homo sapiens
aagcaauaaucaauauuuuaauauuuugaccugagagguacauguauuuaaugggaggggagguacaaauauuugaucuggaaguauuuguaccucucagaucaaaguauuaaaauauugauuauugcuu

SEQ ID NO: 2241417 - RNA, 85 nt, Homo sapiens
auggaaaugauuuaccuuuuguuuuaaguaaucagagaagagaacugcaaaugcaguuuguguacucaggaaguaaauuaucugu

SEQ ID NO: 2241418 - RNA, 96 nt, Homo sapiens
acacuuauucugauuuuuuucacuauaguuuugccuguucuaaaauuccucaaacuuugaauaaacugucaguggagaguaaguagaugagauugu

SEQ ID NO: 2241419 - RNA, 79 nt, Homo sapiens
uaccaaaaaguuaggcaguuuauugauuuucaugaauauauggauuuuauuugugaaugccagugagcuccuauuggua

SEQ ID NO: 2241420 - RNA, 87 nt, Homo sapiens
gaguccugaugaggcuugguuguuugaaaguguguagcaccuacuccuuuacacugucucuugcugaccauguaaugugucugauuc

SEQ ID NO: 2241421 - RNA, 89 nt, Homo sapiens
caggacccuggacuggguagagcacugggggcgagggcuggcagagugcagcccugcuugcaaaguaucugcacauaauguggguucug

SEQ ID NO: 2241422 - RNA, 109 nt, Homo sapiens
accccaaggucucaggucagaauugaggugaagggcagagcagcugcaaucccuugggcaagcugcccuaccucuuugggccucgguuuucucaccugcaaaauggggu

SEQ ID NO: 2241423 - RNA, 103 nt, Homo sapiens
uucuuugacuauggguuaagagcauuauuuaguaauuuccauaaauugggauuuucuaguuauuguuauugauuucuacuuuaauugcacuaugaucagagaa

SEQ ID NO: 2241424 - RNA, 87 nt, Homo sapiens
ucucaagcugugagucuacaaagggaagcccuuucuguugucuaaaagaaaagaaagugcuucucuuugguggguuacgguuugaga

SEQ ID NO: 2241425 - RNA, 76 nt, Homo sapiens
uacuguuaauggauagauuuauuuuuaggguccuuauucuguugccuugaccuauggaucuguuuuuauggcagua

SEQ ID NO: 2241426 - RNA, 92 nt, Homo sapiens
ccuguaguacacagaguaggcuagguguguuuucagaaguccuagaugcuuuggaauguacucuagccuaugcuuugguuugguaaugcagg

SEQ ID NO: 2241427 - RNA, 92 nt, Homo sapiens
cggaguuuguguuuugcuaacagaguuuguaaggcucagaggguguugaaauguuucugagguuacugcuuuguagaacacauaggauuuug

SEQ ID NO: 2241428 - RNA, 130 nt, Homo sapiens
uacacggaaucagccucuacauaggcccagcagguggaacggggguuggcaguugucaauagugaaauguuugccacuuugcuaauccaacccucaucuccuuacagauccuuuguauggcaacccugua

SEQ ID NO: 2241429 - RNA, 66 nt, Homo sapiens
cccaaugaccagaacacagaacaauuuucucucucuuuccucugguuugugcauugggccauuggg

SEQ ID NO: 2241430 - RNA, 128 nt, Homo sapiens
ucuugcuuuuagagucuguuguugucugaguuuaagucaucuaucaccauguccguuuuaaaagcagaggcuuuuaaaaggucugaugauaaaugucuaauauugauauuuagaauauaaagcuaaga

SEQ ID NO: 2241431 - RNA, 85 nt, Homo sapiens
ugugaggacaugagauuugggaggggccaggaguagaaugauaugguuuggcuguguccucucccaaaucucauuuugaauuaua

SEQ ID NO: 2241432 - RNA, 97 nt, Homo sapiens
ugauugcguaauuauuugguuacuugaauagcuaugcuuucaugauccuuuuaauguguuguaaguaguuauucaaggaaucaaaaaugaagcauca

SEQ ID NO: 2241433 - RNA, 77 nt, Homo sapiens
caucacauguucucacuuauuugugggagcuaaaaauuaaaauaauugagcucaucaagauagagaauaaaaugaug

SEQ ID NO: 2241434 - RNA, 91 nt, Homo sapiens
ucuuugggguauugauaauguauucuucaaccuugcuaaacucacuaguucuagcagcauuuuuguagaguauauugaauuuucucaagga

SEQ ID NO: 2241435 - RNA, 72 nt, Homo sapiens
uuaguaguagugcuguaauuuuuauaaagauauauuugcagcaguguaggaugaauuauagcacugagcuag

SEQ ID NO: 2241436 - RNA, 78 nt, Homo sapiens
caguaauaauaaauaugguuuuaugaagcaauugugcaucgugcaugugaguuggauuguaaaauguauuucuugcug

SEQ ID NO: 2241437 - RNA, 71 nt, Homo sapiens
auagcagagaucauucugauccagagucuuugaagcuuuaacaggguaccuggacggauugacuuagcugu

SEQ ID NO: 2241438 - RNA, 120 nt, Homo sapiens
uccuuuaugauaugugucuuugaaaggcaaggaguggcaguaagcagagugauauaaacauggggccugggcuuuaauucugucugcccucauccuuuaugaggcgcaugauuuagaggg

SEQ ID NO: 2241439 - RNA, 61 nt, Homo sapiens
gcuuauauuuguuucuaguggcagcaaguucuguuuugcucaccugagaagaauagagggc

SEQ ID NO: 2241440 - RNA, 62 nt, Homo sapiens
aacacuugaacuuccuguaaucaaugaccuccucucauugaguauagaucaguucaaguguu

SEQ ID NO: 2241441 - RNA, 76 nt, Homo sapiens
gugcacaauacugcauuugucccuuuugaacauguaacagauuaaagagcugggcaggaggcagauguaggggcac

SEQ ID NO: 2241442 - RNA, 76 nt, Homo sapiens
ggaggcugaggugggaagauugcuugagccuaggaauucaagacuacagugagcuaugaucccaccucuguacucc

SEQ ID NO: 2241443 - RNA, 71 nt, Homo sapiens
acuguggaaaugacuuuaaguagucauaguuaaagacacaauugacaagcauauuugguuauuuccauggu

SEQ ID NO: 2241444 - RNA, 67 nt, Homo sapiens
guuuugagcagggcagugaugugggauuuaugcuuugcaaggaucccauuggcugccauguggggac

SEQ ID NO: 2241445 - RNA, 82 nt, Homo sapiens
gguuuuacuaggccuugggcuuuuagguccuuaacaguuuuuuggaguccuuguugggccuugggucuaaggggguacugcc

SEQ ID NO: 2241446 - RNA, 122 nt, Homo sapiens
auugcuuuggauauuuugggcauuuggagaagaggguaauucaaaggccagagaaauuaaacuuucagaauguucuuuaugcgucuguaauuucuuuuuaaaaaaugcccucuaaagacagu

SEQ ID NO: 2241447 - RNA, 70 nt, Homo sapiens
ucaaucaauugaagaaacaaaagcuuccaguauuuuuauauggaguguguuaacuuuacaaguugauuga

SEQ ID NO: 2241448 - RNA, 74 nt, Homo sapiens
aaacagugucaguagugucugugauuuccucaguugcuuagggugaguuauuaguagaggcuauggugaaguuu

SEQ ID NO: 2241449 - RNA, 71 nt, Homo sapiens
uucuacaacauacauauuucaguguccauaaacuccagccauguggauauguuuauauguugucuauggga

SEQ ID NO: 2241450 - RNA, 69 nt, Homo sapiens
gcuuucugaggccucaccagaagcagauggcaacacuacgcuucuuguaaagccugcagaaccauuagc

SEQ ID NO: 2241451 - RNA, 77 nt, Homo sapiens
gacuuugugaaguuguuagaguacaugagcauuacuuggguauguagcaauucaguacuuuggagcucacauaaguc

SEQ ID NO: 2241452 - RNA, 100 nt, Homo sapiens
augaccccuugaucuggaggcugacuuagagauguuguauuugggggcauguauaccucuuuguuguugaauucauggcauucuggguggccaggggcau

SEQ ID NO: 2241453 - RNA, 76 nt, Homo sapiens
acuggaagcuucaucccagaggggcacccggcuguaugagaugucaguuggccccuacugggaggugucucccagu

SEQ ID NO: 2241454 - RNA, 63 nt, Homo sapiens
gguagaggaugaggagguuggacguggugguggcuuugccuuggauauuccucuuccucuauc

SEQ ID NO: 2241455 - RNA, 90 nt, Homo sapiens
agauaccaacaacaaggcaguuuguucuugcuccuuuaagggagagcuucccagaaaaauaagaaguaagcugacaggucguugauauuu

SEQ ID NO: 2241456 - RNA, 72 nt, Homo sapiens
acauccucuccagcaccuguuguuuccugacuuuuuaaugaucaccauucuaacuggugugagaugguaugu

SEQ ID NO: 2241457 - RNA, 62 nt, Homo sapiens
cugaucuauguaagacucccuaguuugauguuuaucuaacugggcaagcauuacaugguugg

SEQ ID NO: 2241458 - RNA, 123 nt, Homo sapiens
aauaccacaguggguguacacacaugggguacacccacugggauauuauugguaauaucuuagagagauauaacuccuaauaucauaguggguguaccccauguguguacacccugugauauu

SEQ ID NO: 2241459 - RNA, 57 nt, Homo sapiens
aucauggggacgguuucuaaugguuuagcaccauccuucuagugcuguucucaugau

SEQ ID NO: 2241460 - RNA, 57 nt, Homo sapiens
cuuaugcaucuuccacacucauuaaauacuuguuugauggguggauggauggaugag

SEQ ID NO: 2241461 - RNA, 74 nt, Homo sapiens
gaagaaaauuuugguuacauaguugagcuuuguucaaaaggugaauaucagcucugauuggccaaggucucuuu

SEQ ID NO: 2241462 - RNA, 79 nt, Homo sapiens
ucuuugagcaagcaaguucacugcuagaaauuuauccuaaggggacgauuuggcaauuuugaagaugccuucucaaaga

SEQ ID NO: 2241463 - RNA, 85 nt, Homo sapiens
caguccaugguauuugguuauugcagccugaauggacuaagauucucuuaauuaaucauggugcaauuaucaaaaucaagaauug

SEQ ID NO: 2241464 - RNA, 60 nt, Homo sapiens
uuguagacaccaaagacagcauagcccagagcagcuaugucugugagagugucugagcaa

SEQ ID NO: 2241465 - RNA, 101 nt, Homo sapiens
cccagcuaaggcucacagcaccccgcuuucuggcacacuagcaaguuguuuuguaagaugcagauuugggcggggccuauuguuuggacucacaguauggg

SEQ ID NO: 2241466 - RNA, 91 nt, Homo sapiens
guuucuccuugcaugagguaagagaauaaacaguuuguuuagggguuuaaacaaaagcuguugcuuuuuuacuuugagcgaaaggagaaau

SEQ ID NO: 2241467 - RNA, 88 nt, Homo sapiens
acuuggucaucaauuacugagagaggaauauugaaaucuguuacuguaauuguggauuugucuguuucuccuuguaguucuaucaggu

SEQ ID NO: 2241468 - RNA, 77 nt, Homo sapiens
gccucuucucaagaaagugcuguagacugggcgcaguagcuacugccuguaauuccagcacuuugggaagcugaggc

SEQ ID NO: 2241469 - RNA, 76 nt, Homo sapiens
augagauauguuaaaaguuaaaaauacagcuguugguaauguguuguaaugaaacuaacuuuugugccuaucuugu

SEQ ID NO: 2241470 - RNA, 67 nt, Homo sapiens
uguuuguucaacaaauaaugugacagugucuaguguuggcacuguuugauuaagugguggaaaaaua

SEQ ID NO: 2241471 - RNA, 59 nt, Homo sapiens
guucuauguugggaguucacuauaaguaggaguucucuaaaagcacuuccacguagaau

SEQ ID NO: 2241472 - RNA, 129 nt, Homo sapiens
ugcuuuuguuuuuuuuugagacagaguuuuugcucuuguuguggaggggagugcaguggggcgaucucagcucacugcaaccucugccucccagccugaagugauucuccugccucagccucccaagua

SEQ ID NO: 2241473 - RNA, 75 nt, Homo sapiens
ucucagcuuccccuuuguaagauggaaacgcaguacuaauaugugcacuguuuaauuucacaaaguugacugaga

SEQ ID NO: 2241474 - RNA, 104 nt, Homo sapiens
ugaggcggagucucgcucuguuguugccuaggcuggaguguagugguaccaucucggcucacugcaaccuccgccucccgggcucaagcaauucuccugccuca

SEQ ID NO: 2241475 - RNA, 80 nt, Homo sapiens
gggauugaaauguaagucuuuguuucuuaaaauaacuuuuuaagguuacaaaggacuucauaguaaaucuuccaaauccc

SEQ ID NO: 2241476 - RNA, 70 nt, Homo sapiens
ggcugugugaugugucaucugagagaguggguaaccccuauucccagcacauggccauuuauuuagagcc

SEQ ID NO: 2241477 - RNA, 62 nt, Homo sapiens
aggucuacaugcuuaauauaucaaacaaauuauagcuuuaggugauugagcaugacagaccu

SEQ ID NO: 2241478 - RNA, 57 nt, Homo sapiens
aguccguagagcuauucagggauuugaacaucuaaucaguaaguaguuuuacagauu

SEQ ID NO: 2241479 - RNA, 76 nt, Homo sapiens
ucuguucaugaccaugguauagaccacaggguggcggaugguagcauagugaucauaggccauggcagagaacaga

SEQ ID NO: 2241480 - RNA, 77 nt, Homo sapiens
uuuuggaaagagguguuuaugacuuuuaguuggagugauguagaaacuguacaguuguaaacauauuuuuuucaaaa

SEQ ID NO: 2241481 - RNA, 69 nt, Homo sapiens
gugacugcauccauccaggcuuuagcugcaagcuggauccuguuucucuuggaaagugcuagaagucac

SEQ ID NO: 2241482 - RNA, 62 nt, Homo sapiens
ggguuagguucuagaggcacaaugaugaauaagguuacuugaucugucuuagagcuugaccc

SEQ ID NO: 2241483 - RNA, 67 nt, Homo sapiens
ucuccacuuuggccagagggcaauuagcugugauguucucaagcguugaauccuguggccuauaaga

SEQ ID NO: 2241484 - RNA, 82 nt, Homo sapiens
uauaaucuaagcucuaggguacaugugcacaacguguucuaggguacacauugugcacauguacccuagaacuuaaaguaua

SEQ ID NO: 2241485 - RNA, 55 nt, Homo sapiens
gaccaucuuugagugauaaugucagugggauagaaugugucacuggauaaugguc

SEQ ID NO: 2241486 - RNA, 59 nt, Homo sapiens
uuacaaccucagcagugcaaagaggcucaccaacuagcugcacuuggaugaguuuguga

SEQ ID NO: 2241487 - RNA, 125 nt, Homo sapiens
ucaauaggucuuggggaacaagugauguuugguuacauguauaaguaccauaauuucauuccuuuuuauggcugaguaguauucuaugguauguauauaccagcauuucuucauccacuuguuga

SEQ ID NO: 2241488 - RNA, 101 nt, Homo sapiens
ucccuaucauuacucucccugcaccccuuacaucagcucugguauccuggaguugggugaaggagcugauguaagggguacagggagaguaaggauaggga

SEQ ID NO: 2241489 - RNA, 109 nt, Homo sapiens
cuugggugguuucuaccuuuuggcaauuguuaauaguguuucugugaacauuuguguacaaguauuuguuggaauaccuguuuuuaauucuuuuggauauauaccuagg

SEQ ID NO: 2241490 - RNA, 126 nt, Homo sapiens
uuguugggaacuggagcaaagaugucucuuguuauguuuuagcaaaaagacuggcagcauuuugcuccugccauagagauuuguggaacuuuaaacuuaggagacauuauuuaggauaucuggcag

SEQ ID NO: 2241491 - RNA, 60 nt, Homo sapiens
cucauuaguuguuuuaagaugacucuugcugcagcuaccaucuuacagcagcuauaugag

SEQ ID NO: 2241492 - RNA, 57 nt, Homo sapiens
uauuuaaggagagcuuuauuuuaaggcauguuugacucaaaaugcucuucuggaaua

SEQ ID NO: 2241493 - RNA, 93 nt, Homo sapiens
cuguuuggaccaccuuaacuggaaagagaacugacaguaccugggaguuauagaagcccagcuggccaguucucuugccuggagaccagacag

SEQ ID NO: 2241494 - RNA, 75 nt, Homo sapiens
cuucagcaggccaggcccugacuggaugcuggcgagucgagaaaaacacaaucgggccuccggccuugucugagg

SEQ ID NO: 2241495 - RNA, 86 nt, Homo sapiens
gagaauugcuugaacccaggagguggagguuguagugagccgagauugcacuacugcacuccagccugggugacagagugagacuc

SEQ ID NO: 2241496 - RNA, 63 nt, Homo sapiens
ugcacacugcagucaccaaggagguaacuuuccaccauuacuugagacaaaugcgugugugca

SEQ ID NO: 2241497 - RNA, 80 nt, Homo sapiens
uugguuagguaguggaaccuucuaaaugacgcacuaugugauuccugugucauauagaauguucuaugauucuuagccag

SEQ ID NO: 2241498 - RNA, 58 nt, Homo sapiens
gggaaggucuagggcugaagguuguuguuuagauucuuuugucccaugggcuguuccc

SEQ ID NO: 2241499 - RNA, 64 nt, Homo sapiens
auugugaauagugcugcagcaaacauacaugugcgugugucuguauagcagcaugauuuauagu

SEQ ID NO: 2241500 - RNA, 104 nt, Homo sapiens
cugauuuuuguauguggauuuuauauccugaagcuuuacugaauucauuuaucaagucuaagaguguuuugguggagacuuuaggguuuucuagauauaaucag

SEQ ID NO: 2241501 - RNA, 64 nt, Homo sapiens
auugugaauagugcugcaaucaacauacaugugcaugugucuuuauagcagcaugauuuauaau

SEQ ID NO: 2241502 - RNA, 66 nt, Homo sapiens
augaaguuuucuggagugugaaguggauaugucuuauaaguuuaauucacagcuucaccacuucau

SEQ ID NO: 2241503 - RNA, 106 nt, Homo sapiens
uggagccuacugaguugaagaaaugcuuaucaacccugacacaagcagaauuuuaggccuaacaauucuuuguuguggggggcucuucugugcaucagaggcuuua

SEQ ID NO: 2241504 - RNA, 89 nt, Homo sapiens
aucauaugguuuuugucguugguucuguuuauaugcuggauuauguuuauugauuugcauauguugaaccagccuugcaucccagggau

SEQ ID NO: 2241505 - RNA, 61 nt, Homo sapiens
ggaggcaaagcacuuugcuuggaaauauuuuucacaugacauacaaggugcuucgaccucc

SEQ ID NO: 2241506 - RNA, 77 nt, Homo sapiens
aaaaugcaaauuauugggccccaacuucugaucuacugaaucagaaacucugaguugagcccagaaauuuguguuuu

SEQ ID NO: 2241507 - RNA, 71 nt, Homo sapiens
gugagggggacuaguaagauaauauaaacaggaguuuauccaguaaguauuguacuacaagcucuuuauac

SEQ ID NO: 2241508 - RNA, 114 nt, Homo sapiens
gugagggcaaaugguucaguagaguguguugugauagguggcugggcgcagguuagcaauugugaccucuguugcugucacuauugucacugcugucuaaaucauuguccucau

SEQ ID NO: 2241509 - RNA, 99 nt, Homo sapiens
gagguggguggauugcuugagcccaggaguuagaggcugcaaugagcucugacugggccacugcacucuagcuugggugacagagcaagacccugucuc

SEQ ID NO: 2241510 - RNA, 86 nt, Homo sapiens
acucagcagucaggggagauggcaaugcgauggugacugagugucuuagucuuuuuuguauugcuaugcaauaucugaggcugggu

SEQ ID NO: 2241511 - RNA, 79 nt, Homo sapiens
gcucccugugguugggagaucuuuaggaguuggacuaucuuaaagauagacuaucuuaaaguuuucugaucauuugagc

SEQ ID NO: 2241512 - RNA, 63 nt, Homo sapiens
cugacugaggaucaguucaucaggacccccaccggggacgaguuugugaagaccucagugcgg

SEQ ID NO: 2241513 - RNA, 105 nt, Homo sapiens
ucugaggcacaagaaucauuugaacacaggagcuggagguugcagugagccagguucaugccacugcacuccagccuugauggcagaucaagacucugucucaga

SEQ ID NO: 2241514 - RNA, 83 nt, Homo sapiens
aaggaguuagaaaugcagcauuguuuuauacuuuucaaauuuuaaugucucaguaaaagacagcuggaguaucauagcugcuu

SEQ ID NO: 2241515 - RNA, 67 nt, Homo sapiens
gagaaaacugggaagaaggagugguuuacucuucaggcagagugcaaguucuuccuucuucuuucuc

SEQ ID NO: 2241516 - RNA, 75 nt, Homo sapiens
cgagaaguugaaugaaauugguguggggauaucuguggagucagauuuccuuuggauuuuucauuuaaccccuug

SEQ ID NO: 2241517 - RNA, 58 nt, Homo sapiens
uaaggcucuuguuauuuugagguauguuccaucaauaccuaguuuauugagaguuuug

SEQ ID NO: 2241518 - RNA, 62 nt, Homo sapiens
gcaggcagaaaaaugugaaaagagagauuggccuagucucccagccuacaucuuucuccugu

SEQ ID NO: 2241519 - RNA, 75 nt, Homo sapiens
gugagauuguaucauaacuuuccuuucucauacugucuuugccagguuuugagaucaagguuaauauaaucucau

SEQ ID NO: 2241520 - RNA, 69 nt, Homo sapiens
gucucuguacaguggguguagggaccagccacacagggucgguggguuuuucuccccgugugcagagau

SEQ ID NO: 2241521 - RNA, 61 nt, Homo sapiens
caagccuagcagacaggcugggagcagagcaaacgggccucuucacugucugcugagcuug

SEQ ID NO: 2241522 - RNA, 78 nt, Homo sapiens
aacaguauaauuggaucucaaaaaaguguuguaaacauucaucaugauggcacuugcauguugaaucuagugacuguu

SEQ ID NO: 2241523 - RNA, 55 nt, Homo sapiens
gaagauucaaccaaaccagaacaccaauaaaacggguugacuugguugaauuuuu

SEQ ID NO: 2241524 - RNA, 78 nt, Homo sapiens
gugucacuagcauuuaggggcuugagggccagggaucaggugaucuuugagugcccugagucccucaugggaggacac

SEQ ID NO: 2241525 - RNA, 65 nt, Homo sapiens
cuuucucagugagacccgagaugcuauguaagucuaacaaccaccucacugcuguacuggggaag

SEQ ID NO: 2241526 - RNA, 55 nt, Homo sapiens
uuucucaguguuucaggguagguuauaagcaaaguuacuuugaaaauacuggaaa

SEQ ID NO: 2241527 - RNA, 97 nt, Homo sapiens
gagccaugaucuugacacuggacuccagccugggcaacaaaacaagaccaucucacucuguugcucaggcuagaguucagcuacacaaucauagcuc

SEQ ID NO: 2241528 - RNA, 64 nt, Homo sapiens
ggcaauaagagaugucuuauguuucccacccgcugaggaaaguaacccauucucuuacuuugcc

SEQ ID NO: 2241529 - RNA, 55 nt, Homo sapiens
cggagauauuuaagguucucuccauguaaggacauuagaaucuaaauuauuucug

SEQ ID NO: 2241530 - RNA, 64 nt, Homo sapiens
cuucccucuccaggagcccugagcucugguucagguaguuuaacuguuccacuggagagagaag

SEQ ID NO: 2241531 - RNA, 68 nt, Homo sapiens
aaauggugugcuuaggucauuuacauuuuagguaauuacuuauauguuuguacuuaggccuauuauuu

SEQ ID NO: 2241532 - RNA, 69 nt, Homo sapiens
cgcagggauuguauguauguaugcauguguaugaauauauguuauguauacauauguauguuuugugcg

SEQ ID NO: 2241533 - RNA, 107 nt, Homo sapiens
auuucaccaccaucauuaacacugccauugauacugucaucucugccacacgauuaauauugccaaugagacaguuagugcagccauguuaacacugccuuugagau

SEQ ID NO: 2241534 - RNA, 59 nt, Homo sapiens
cagauggcucaguguguaucuaucacccccaguggagaaguaauacugagcacaugcug

SEQ ID NO: 2241535 - RNA, 63 nt, Homo sapiens
uauagcagccugaacaaaguaaggaaaaugguaacauuuaguacuuuugacacaggcccuaug

SEQ ID NO: 2241536 - RNA, 96 nt, Homo sapiens
ugugaggacaugagauuugggaggggccagguguggaaugauacauuuaggcuuuguguccccacccaaaucucaucuugaauuauagucuccaua

SEQ ID NO: 2241537 - RNA, 77 nt, Homo sapiens
uuuuguauaguaguacaaaaguuuuucuacagcccuuuuaauggcugcaugaaaugccuuugugugacuguacuaaa

SEQ ID NO: 2241538 - RNA, 82 nt, Homo sapiens
cagcaaggggcaguggguuccucagagauacccucuggccccuccacagcuggcuccuugaaggaacgcuguucccuugcug

SEQ ID NO: 2241539 - RNA, 76 nt, Homo sapiens
uuuuguuuuauagguccugugagauucaugcucaaagagguucuguuuugauguguuuccaggauuuguuucaaga

SEQ ID NO: 2241540 - RNA, 63 nt, Homo sapiens
uuuagagcccaugugagugugaucgagugaaagcucuguguuaaugcuccauggguuauuaaa

SEQ ID NO: 2241541 - RNA, 56 nt, Homo sapiens
ugaugguuuuaaaaagaggaguucccuuguacaacucucucuuuuuccugcucuca

SEQ ID NO: 2241542 - RNA, 71 nt, Homo sapiens
cuuuuugcuagagucuagggucaaacacgcucuuguguccucacuccucgcccuucacuccuggcagaaag

SEQ ID NO: 2241543 - RNA, 79 nt, Homo sapiens
uagaccuuuaauaccuuugguuacauuuuaccuaugugcuucuuuuuggggugguaauguaacugguauucuguuucua

SEQ ID NO: 2241544 - RNA, 120 nt, Homo sapiens
cacauuuacugaagauguccuauguguaugcugugccugaugucauugucagaauuuucuuagucaucaccaucacucagugacaucguugccauguuaugcacaaggaaagugagugug

SEQ ID NO: 2241545 - RNA, 67 nt, Homo sapiens
ucugccuuagcagcaauuaucaaucucauuaaccuauagacauguuuguuggauaguuguuggcaga

SEQ ID NO: 2241546 - RNA, 101 nt, Homo sapiens
gucucugaguaaacaaagugcaugacugauauuugagauacuucaugccuuaucucuggauaucuacuuauguucuauuuucauuuguuuguuuuugaagu

SEQ ID NO: 2241547 - RNA, 56 nt, Homo sapiens
gugagaugugacuucugccucuauuagcacuuagaguugcacuauucauauuuuau

SEQ ID NO: 2241548 - RNA, 55 nt, Homo sapiens
ggagagguagcaaacauuuuuuucaaagcaucagcuagaguauuguuacuucucu

SEQ ID NO: 2241549 - RNA, 58 nt, Homo sapiens
uuuuacagaggagguugcugauuuuucucuucuggaauugauaacuuucacugugaga

SEQ ID NO: 2241550 - RNA, 55 nt, Homo sapiens
uugagauggagucucgcucuuuugcccaggcuggagugcaauggcaccaucucag

SEQ ID NO: 2241551 - RNA, 72 nt, Homo sapiens
gguuauuuucauagauaaagauaguaauagagaagaugaauaucuguuacugcucuuuugucaugaguaauc

SEQ ID NO: 2241552 - RNA, 79 nt, Homo sapiens
guaacaaagggagcugcauaaucuuguggucuguucugagcuccaugcacaggauaaugcagcuccugauacugauugc

SEQ ID NO: 2241553 - RNA, 129 nt, Homo sapiens
ucuuccucuuucucuuccucccccuccucuucuuccuucuucuuagugguauagacuugaaauuguuuaaagcaugacgagaagaagcuuuuggagagagaggcugaagaaucggggagcagaggaagg

SEQ ID NO: 2241554 - RNA, 79 nt, Homo sapiens
uucuuacaaggcaagaaugcgugcuuucaccacuuccacucagcaaugaauauacagguucuagccauuguaaaaggaa

SEQ ID NO: 2241555 - RNA, 81 nt, Homo sapiens
ggagcauaggaugcacuguguguauuagcucauuuguauuuuucccacuucaaugagcuggucuacguguguaugagcucu

SEQ ID NO: 2241556 - RNA, 92 nt, Homo sapiens
gggggguacggguguaggauuguuacauggguauguuggauccggguagugagccuaguacccaguagauaguuuuucauccuguacccucc

SEQ ID NO: 2241557 - RNA, 100 nt, Homo sapiens
uugauugcauaauuauuugguuacuugaauagcuaugcuuuucaugauccuguuaauguguuguaaguaguuauucaaggaaucaaaaaugaagcaucaa

SEQ ID NO: 2241558 - RNA, 123 nt, Homo sapiens
ucugggggacaauuaccuguauaauagguucuauagauaauuuuuagauggaauuuaacuuguaaccucuguacugccaaguuucuuuagaggaccuauuuuuucauuccuuuguuuuccaga

SEQ ID NO: 2241559 - RNA, 85 nt, Homo sapiens
agucuuauuauuucuuucauauuuuauaacuguuucugagaccuuuuguuagauaagagaucaauaugaaggaaaugugggugcu

SEQ ID NO: 2241560 - RNA, 77 nt, Homo sapiens
ugguuuugucuuugguucuguuuauaugcuggauuacauuuauugauuugcauauguugaaccagccuugcauccca

SEQ ID NO: 2241561 - RNA, 61 nt, Homo sapiens
gcuggaagucauugagguguguuaaucccuguagcuguaguaacaaauuuagugacuuagc

SEQ ID NO: 2241562 - RNA, 103 nt, Homo sapiens
ugcuaccagugugacaucacugaaugugagguuggggagagauguacaguaacacaucaugacaguacuuccagcacucagauucagagggaccacaagagca

SEQ ID NO: 2241563 - RNA, 55 nt, Homo sapiens
auaaggucauacugcaguggagugggcccuaauccaauuugacugguguccuuau

SEQ ID NO: 2241564 - RNA, 73 nt, Homo sapiens
uuugcuagauuguuuccauaaugacauauauaaacuacuuuucuuugugucaccguuagaacaauuuaacaga

SEQ ID NO: 2241565 - RNA, 64 nt, Homo sapiens
auugugaauagugcugcaauaaacauacgugugcaugugucuuuacagcagcaugauuuauagu

SEQ ID NO: 2241566 - RNA, 67 nt, Homo sapiens
cauuuguucagucugaauacaaaucaaggguaaaaaccacauggcagugucacagacaugacagaug

SEQ ID NO: 2241567 - RNA, 66 nt, Homo sapiens
agcagcauuaguggaaucuugucacaacuaaaucccaauagugcucgagcuuugcauuaagcugcu

SEQ ID NO: 2241568 - RNA, 55 nt, Homo sapiens
uugagauggaguucauuuuuguugcucaugcuguaauacaauggugcuaucucag

SEQ ID NO: 2241569 - RNA, 95 nt, Homo sapiens
cagaucaacugucauaucacagugcuuguguucagguaaccuuuauuuuacuaauaauggccccaaagcacaagagcagggaggcaguugauuug

SEQ ID NO: 2241570 - RNA, 55 nt, Homo sapiens
ugauaucucuugccuccaaaugccaagcaaaaauccugggguugggaagauguca

SEQ ID NO: 2241571 - RNA, 68 nt, Homo sapiens
gagguggaguuggcacugagcugugauugcaucacugcacuccagccucagugacagagccagaccuu

SEQ ID NO: 2241572 - RNA, 68 nt, Homo sapiens
ggacaucacuaacaaucacagcucucauucaagccaugccuaugaugcugcaguuguugccaaugucc

SEQ ID NO: 2241573 - RNA, 66 nt, Homo sapiens
ugcugaaggcaagguggauaaugaagcuguaguaggcuugcacaaacacuugucuggaauuuagua

SEQ ID NO: 2241574 - RNA, 62 nt, Homo sapiens
gcugcagcucuucucuccuucuugucaucugcaauguggcaagugggagggaguguuucagc

SEQ ID NO: 2241575 - RNA, 111 nt, Homo sapiens
ggaugggacgagcuugacucaugaacuuaacaccuuugauagcacuuuuuaucuacagauaaugagugaaaaguuuaaaguauugguaggucuuggucauuguacauaucc

SEQ ID NO: 2241576 - RNA, 58 nt, Homo sapiens
ucuugacaagggagugagucucaaagagggacgcaacccccucacacccuaaucagga

SEQ ID NO: 2241577 - RNA, 59 nt, Homo sapiens
ucccagucuagagccggauuggcgaguuagacgcuuguagauccaagguuggauugggg

SEQ ID NO: 2241578 - RNA, 129 nt, Homo sapiens
ggacauucacuaagcccaucaugcauguuauuagagaguuggcagcauuccagccaagcacauaaagugcuggcaccagaaugacugcagacucucauguccacagcagcuguuaggucugugaugucc

SEQ ID NO: 2241579 - RNA, 74 nt, Homo sapiens
agaguccugagguagcucaggguauugcauaguugaggaggacugagcauacuaaugugcuagcucaggucucu

SEQ ID NO: 2241580 - RNA, 69 nt, Homo sapiens
auucccagccaagaacgcagcgugcuggggagcaaccuccccugagucaccugcuucucaccucggaau

SEQ ID NO: 2241581 - RNA, 62 nt, Homo sapiens
uuuuccuguaugcacgucuugucuuauccccuccugggaauuuucagugcaauacaggagag

SEQ ID NO: 2241582 - RNA, 61 nt, Homo sapiens
gugcgguauuagcaagccaacacagcugcagauuuaaagcugaugguuuaaauacccguau

SEQ ID NO: 2241583 - RNA, 106 nt, Homo sapiens
auuucccagucucagguaugucuuuaucagcagcaugaaaauagacuaauacagaaaagugguacuaguggggugcugcugaaaagauaccugaaaauguggaagu

SEQ ID NO: 2241584 - RNA, 67 nt, Homo sapiens
guuugagcaguuuaaaucuguauuuucuaucuaauugauguguugcaagaggagacuguacucagac

SEQ ID NO: 2241585 - RNA, 88 nt, Homo sapiens
ggagaauugcuugaucccgggaggcggagguugcaguaagccgagaucgcgccacugcacuccagccuuggcggcagagcgagacucc

SEQ ID NO: 2241586 - RNA, 60 nt, Homo sapiens
uuugauguaggcacuuaaugcuauaaauuucccucuuagcacugguguugcuauaucaaa

SEQ ID NO: 2241587 - RNA, 99 nt, Homo sapiens
ggagaaggucucaggagcauauugggucagguauguguggaaaggcccuccaggcucaaauucacacugggccuacucugugcccugacuccaagcucc

SEQ ID NO: 2241588 - RNA, 96 nt, Homo sapiens
uagggcaauagcucagcagugcagcaucaaaucacacaagaugcuggucccuucugaaucuuguauuuugguagcuaugccugagcccuugccuua

SEQ ID NO: 2241589 - RNA, 77 nt, Homo sapiens
gcugggcacacacuggccagugcaagacuuuccagagcucucuuuccuucugucacaguggccagugauguuccagc

SEQ ID NO: 2241590 - RNA, 130 nt, Homo sapiens
gggaagggggcguauuuuguuuuuuggagacaggaucuugcucuguuguccauccugggacuguagugauacagucauggaucacaguagccucaaaggccugggcucaagcaguugcccaccucagccc

SEQ ID NO: 2241591 - RNA, 80 nt, Homo sapiens
gacuuugguauugugagaacuguagggaacagccuugcuuuguaagcuuagggauuuacagucucaagagugcugcaguc

SEQ ID NO: 2241592 - RNA, 88 nt, Homo sapiens
uuuuauauagggcauucaauuaauauuauacucucagauagugucuugagagauaauugugguuggguaauccuugccuuaaguaaaa

SEQ ID NO: 2241593 - RNA, 93 nt, Homo sapiens
caggaaacauguuuggaaagaucagcuaaauguaaguuggugacucccacgcagcuaaaauuguguacauuggagccugauuuucuuuuccug

SEQ ID NO: 2241594 - RNA, 92 nt, Homo sapiens
uuuuauuaugugugagauggugugcuaggaaauguauuaaaaucaccuacuuuucuguauuuucuauuagaccauaacauuuuugaauaaaa

SEQ ID NO: 2241595 - RNA, 55 nt, Homo sapiens
ucacucagaccuggugauaugccaaagagaaagaggcaucacacauuucugaugg

SEQ ID NO: 2241596 - RNA, 77 nt, Homo sapiens
ucuccucugaacuccagacccauaagccccaguugucuacucagcaucucccuuaugggucuggagaucagaggaga

SEQ ID NO: 2241597 - RNA, 78 nt, Homo sapiens
gggacucuucggaggcaugacacaagaugagccuugauaagcgcuugcaccuuaugucuguucucucagaucacuccc

SEQ ID NO: 2241598 - RNA, 70 nt, Homo sapiens
gacagcuguuguuccagucuuuuaauggguauuuguauagcaaacaaccuuggaagcuggagauacuguc

SEQ ID NO: 2241599 - RNA, 73 nt, Homo sapiens
ggcuguccaagaagggaaggaagcugagggugaaggagggagccugacccucagaccaguuucccuggcagcc

SEQ ID NO: 2241600 - RNA, 106 nt, Homo sapiens
ccuccuuggucuggccugcugucaugcaggguucgccagcccacugaggaugaagaggagggcugaggggcugguaggcucugggugcuggcaagcggaagggagg

SEQ ID NO: 2241601 - RNA, 63 nt, Homo sapiens
uuauuagcacccuaccauguggaagagcuuuccuucuuuauucauauuaguaugggcuaauga

SEQ ID NO: 2241602 - RNA, 59 nt, Homo sapiens
ccccaucugugugguuuuaucuaccuuuggucuuugaugaucaugaccuacagaugggg

SEQ ID NO: 2241603 - RNA, 57 nt, Homo sapiens
guacagugcucacaaugagagcaggugaugaugucuguccuguguuaggcacugugc

SEQ ID NO: 2241604 - RNA, 129 nt, Homo sapiens
ggaacauuagcaacuauuugucaauuuguguuuucgguguuaguguuuugucauuuguugguuuuaaaaaucaccgugaauuaacaacacuugauauaaugaaggauuuagugcauaugccaaugucac

SEQ ID NO: 2241605 - RNA, 74 nt, Homo sapiens
gucuuuaucagcagcaugaaaagcaacuaauacaguaaauugguaucaguugagugaagugcuacugauaagau

SEQ ID NO: 2241606 - RNA, 55 nt, Homo sapiens
ggcaacaauuccuacuucuuuuuucucccccgagauggaguacugcuuuguugcc

SEQ ID NO: 2241607 - RNA, 57 nt, Homo sapiens
auagaagcugccaacguuucaggcuugcacucucugaagccauggcccaagcucuau

SEQ ID NO: 2241608 - RNA, 75 nt, Homo sapiens
ugauguacaaugucaggagcaaugauaaauuugccagcaaucugaaaugugucaccuuuugacuuaguggaugca

SEQ ID NO: 2241609 - RNA, 78 nt, Homo sapiens
aguagcgcgccacguagauuccuccaugcgcaguucacaguaggguuugugcuccuaugagaaucuaaugccgcugcu

SEQ ID NO: 2241610 - RNA, 57 nt, Homo sapiens
uuccagacaaaacuguaaaugcuaagccaaauagagcucuucaguuuguaucugggg

SEQ ID NO: 2241611 - RNA, 79 nt, Homo sapiens
uucccuacagcuggugaaucugaauugaauccuuaguaaaguuucauauuaggugauuuaguagaugcuaguuaaggaa

SEQ ID NO: 2241612 - RNA, 77 nt, Homo sapiens
ucucaaagugaugguauuaggaaguugggcccuuagaaagugacugggcccugaagacuccaccgucaugaaugaga

SEQ ID NO: 2241613 - RNA, 66 nt, Homo sapiens
aaauugaaugugauggguuucaugugggucuuggauauauauguuauaccuaucucauuccaauuu

SEQ ID NO: 2241614 - RNA, 64 nt, Homo sapiens
guucuaugagccaaggaugaaaaagaguggagguuccauuauuuaaucaccuugcuuuuagaac

SEQ ID NO: 2241615 - RNA, 57 nt, Homo sapiens
ugacauggagagagaagccuuugaugguuucagaucaaagcgucucuccauauguca

SEQ ID NO: 2241616 - RNA, 92 nt, Homo sapiens
uugggguggagaguugugaagaugugcaucagauccauuugguccaauguugaguucagguucugaauaucuuuguuaauuuucugccuuga

SEQ ID NO: 2241617 - RNA, 63 nt, Homo sapiens
cagugaaacgcucuugcacuggaucauguguccguacauauucacuuuacagagcugucauug

SEQ ID NO: 2241618 - RNA, 75 nt, Homo sapiens
aggcugaggauuuggcagugaagggaucacagauccaugaagguguggucuccccagugccagcucucugggccu

SEQ ID NO: 2241619 - RNA, 74 nt, Homo sapiens
gauguuuauugcuaacugaaauaagaccagcaaugaacaguccgaggcugguacagcagcuuagcaauagcauu

SEQ ID NO: 2241620 - RNA, 70 nt, Homo sapiens
uggaaaguuuuucaacuccuacugaguucaacuccuacugaauugaggcaaugaggagaagcugccucca

SEQ ID NO: 2241621 - RNA, 56 nt, Homo sapiens
guaucauacuguuuugauuacuguaucccugugguauaguuugaguagugugaugc

SEQ ID NO: 2241622 - RNA, 55 nt, Homo sapiens
uugguccguugugaaaaggccucaguaacuuuuuagguuuguucugauggauuaa

SEQ ID NO: 2241623 - RNA, 80 nt, Homo sapiens
gggugaguucauacuuugcuuaucccaggcacuggauaaauauuuaugcgguuugaggagugagcagagaugacugacuc

SEQ ID NO: 2241624 - RNA, 69 nt, Homo sapiens
agggaagguuucaauagauacagaacuauuuugaguuugcauuucguuuugauaaguugcacuuuccuu

SEQ ID NO: 2241625 - RNA, 60 nt, Homo sapiens
ugguugaaguggaaauugguucaauuuuggaaaacaguuuggcaguaucuacuacagcua

SEQ ID NO: 2241626 - RNA, 76 nt, Homo sapiens
gugugucuguguaauggugcaugugugucugggagugaaguugagggcaugcauuguacuaguaugccuaccauac

SEQ ID NO: 2241627 - RNA, 65 nt, Homo sapiens
uuuaugguuuauuagcaggguuauuggucaagauuaaaagcauguagcuagcuagaaaccaugaa

SEQ ID NO: 2241628 - RNA, 55 nt, Homo sapiens
auguggaggguuguaaugaaugccuugaauuggugguuuauagcacuucucacau

SEQ ID NO: 2241629 - RNA, 62 nt, Homo sapiens
uguaugugauggaguuucauggacuggcugcaguacagauucaaguuuuuccauuauuuaca

SEQ ID NO: 2241630 - RNA, 129 nt, Homo sapiens
cuucagccucccaaagugcugggauuacaggcaugagccacugugccuggcccaauuuuuuaaaugauacaaaaaguagcuggaugcaguggcacauaccuguagucccagcuacuugggaggcugagg

SEQ ID NO: 2241631 - RNA, 86 nt, Homo sapiens
caugagggcagagacuuugauuaguuugcugcaauguguugagcaucugguacacugcugaguaaauaauuuuuucugucuuuaug

SEQ ID NO: 2241632 - RNA, 103 nt, Homo sapiens
auccuguuccccgcucuuggaccacuugauuucuggucacaguuuuugcauuccgcuauuccugggcuauaaucauguaggcuucagggcaggaggacaggau

SEQ ID NO: 2241633 - RNA, 57 nt, Homo sapiens
ggggcugugaccugccauacagagggagagcuccucugucacuggggcacauguccc

SEQ ID NO: 2241634 - RNA, 63 nt, Homo sapiens
gaagaggaaguggcauugcaguugagacugagucuguuugccucugcacauccacucuacuuc

SEQ ID NO: 2241635 - RNA, 89 nt, Homo sapiens
ugagguggcugggucagaugaucugguaagaacuuccaguccuaacauuccaaguuucuaugauacacugaaguaacccagccuucuca

SEQ ID NO: 2241636 - RNA, 65 nt, Homo sapiens
ccugagccacugugguccucccaugauaugaacagagucugucguggagcucacagugugccagg

SEQ ID NO: 2241637 - RNA, 70 nt, Homo sapiens
gccaucuugagcuuguugcuguuuccucgagucuugguuauuuguuauagccuguaggccuuaagguggc

SEQ ID NO: 2241638 - RNA, 81 nt, Homo sapiens
ggugucucuguggcccuaggguagggcucuacugcagcccuaggguagagagcuaggccacuggggcuuccagauugcacc

SEQ ID NO: 2241639 - RNA, 79 nt, Homo sapiens
cuuuguaaacagggcccagcucuauugaauuacaggucgcaggucugugaucaaccugcagggcuggaccuguacagag

SEQ ID NO: 2241640 - RNA, 85 nt, Homo sapiens
gguuaacgagugauuaaaucaggaaaaaaaauguacagauuuugacuuugaguccaguacucuuuccugaaaaucaaguuaagcc

SEQ ID NO: 2241641 - RNA, 59 nt, Homo sapiens
uucuucaggcauucccagaagcugaugucagagcuaugcuucuugaacagccuguagaa

SEQ ID NO: 2241642 - RNA, 116 nt, Homo sapiens
agaaagaauuuuucuggacccagagcaacuuggcauuuuuauuagaucaaaaucaaauccaauagaguccugcucgaguugcuuccuuuauuaaaauggaaacagacaguauuucu

SEQ ID NO: 2241643 - RNA, 77 nt, Homo sapiens
gccugagaaauuagcauggucacuuugggccccauaccuugggguaugugggcucugaccugacuuuaaauccaggc

SEQ ID NO: 2241644 - RNA, 60 nt, Homo sapiens
uuugagauggugaagucucacucugucgcccaggcuggagugcaaugacaugaucucgga

SEQ ID NO: 2241645 - RNA, 78 nt, Homo sapiens
gucuguguguugaaggccaggcagggagcugugaacuguaggauguuuagcagcaucccuggccuguacccauuagau

SEQ ID NO: 2241646 - RNA, 94 nt, Homo sapiens
cugcucugccuucugugcucagcaguuguuucggauugggagucaggaggccauucccacacuugaaacaaggcugcaagaggaggcugagcag

SEQ ID NO: 2241647 - RNA, 102 nt, Homo sapiens
cucccuggaguguguggggaacucaggaccucuugccuggaagccuccugcagcuacaggggcuuccguaggagagauccugccuccggaucucccugggag

SEQ ID NO: 2241648 - RNA, 78 nt, Homo sapiens
aauugugguuugaugaaaccucaaaaugaagcaucuuacagaacaguauauguuacggaguuuuuauccaguacaguu

SEQ ID NO: 2241649 - RNA, 82 nt, Homo sapiens
gaggguguucaugugccauucucauggcgcuugguuagagaaacgaccgaguggccuguguaguggggcagcgcuaacccuc

SEQ ID NO: 2241650 - RNA, 115 nt, Homo sapiens
agcccgcggcuucccuccugcucgcuacuugacacuuugguucaccugaguuucccucgcagagccuggagcugguggccagagagcagaggugggugggcugccacugugggcu

SEQ ID NO: 2241651 - RNA, 61 nt, Homo sapiens
gguguugggaaaacuggcuagccauaugcagaaaagugaaacuggaccccuuccuuacacc

SEQ ID NO: 2241652 - RNA, 106 nt, Homo sapiens
agacuguagaacugcuuauugagagguucuuggaauuagacaaguggugguucaaaauagacccucuugagguuccaagauggccaaauaggaacagcuccagucu

SEQ ID NO: 2241653 - RNA, 62 nt, Homo sapiens
ggaggggaaaccaggguugcuaaggucacagugagcugaacauuuggcccugguucucuucu

SEQ ID NO: 2241654 - RNA, 66 nt, Homo sapiens
guauugcagauucgcuuuguguuggggcacuccuucaacacuuaaccaagcuguuugcaacucuac

SEQ ID NO: 2241655 - RNA, 129 nt, Homo sapiens
cuacuuuuuucuuuaggacuuugacacucuaggaauaugguuaugccuaugcuuuuugugucuaaugcacaauuagcagcauuaugauauaucuuaaguugauuguuuaauauucaaauaucuagguag

SEQ ID NO: 2241656 - RNA, 81 nt, Homo sapiens
aguucuaggguacaugugccaacgugcagguuuguuacauauguauacaugugccauguugguaugcugcacccauuaacu

SEQ ID NO: 2241657 - RNA, 58 nt, Homo sapiens
gugcacaagguacagguuuguuacauagguauacaugugacauguugguuugcugcac

SEQ ID NO: 2241658 - RNA, 62 nt, Homo sapiens
uuaaguggugcauuguuaaauggggucaucagcaugggcuucauuaagaagguaugauuuga

SEQ ID NO: 2241659 - RNA, 75 nt, Homo sapiens
ucacuugaaccuuggaggcagagauugcagugagccgagaucgugccauugcacucugcauuccagucuagguga

SEQ ID NO: 2241660 - RNA, 69 nt, Homo sapiens
aucuaagcaaguucggucacaugcccaccacugaaccaaucacuguggcuuugauugacuuauuuaggu

SEQ ID NO: 2241661 - RNA, 73 nt, Homo sapiens
ggagugcaguggcaagaugacuacucacugccaccuccaacuucuaggcucgagagauccucuugccaccucc

SEQ ID NO: 2241662 - RNA, 80 nt, Homo sapiens
ucugcaaguuccccugcagagcaggagaggcaucgggagcucguggucccccuccacucucgcaaaccuggggaaccaga

SEQ ID NO: 2241663 - RNA, 58 nt, Homo sapiens
uggccaucugaaaguuccugaugggcauucacccaucaggaaccuuuuugguguguca

SEQ ID NO: 2241664 - RNA, 80 nt, Homo sapiens
aguuucacagucuauuucaaagaaaagauuugcauuugugaggcacacaucugcaguacuuugaaauauacuggcaaauu

SEQ ID NO: 2241665 - RNA, 81 nt, Homo sapiens
gaauuguaucucccaaaaagguauguucguagguuccaaccccgguaccugugaauguaaccuuauuuggaaauaggauuu

SEQ ID NO: 2241666 - RNA, 91 nt, Homo sapiens
agcaguugauggaucucuggauuuuugaggcaauauauagaacauuugugugugugucugauggauuuacugguuacaucauaagauugcu

SEQ ID NO: 2241667 - RNA, 78 nt, Homo sapiens
gcagcaucuuacguaguuuuggagaucauaaacaacauuuuguguucuguauuauguaacgacuaauuuccaugcugc

SEQ ID NO: 2241668 - RNA, 69 nt, Homo sapiens
gugucaugggcauguccuuaaccuuagcaaaauacacuuccuaaauugauugaggccugucccagauac

SEQ ID NO: 2241669 - RNA, 58 nt, Homo sapiens
caucagcaauguaugaggguuccgauuucuccauauccuuuucaacacuugcuggaug

SEQ ID NO: 2241670 - RNA, 58 nt, Homo sapiens
gacaugaggaagucaggcccaggggcaccguccagccucaccugccuuccucaugguc

SEQ ID NO: 2241671 - RNA, 63 nt, Homo sapiens
gugggguaggguaggacucaacaaucuauauuuuuagagauaauucaggcugccuugccuuac

SEQ ID NO: 2241672 - RNA, 66 nt, Homo sapiens
aucagaaucucuagaggacuguccagggaauguuuauuuuucaaaccuccuccaggggauacugau

SEQ ID NO: 2241673 - RNA, 67 nt, Homo sapiens
ggaaaggggcaguggagagggagugugugcuguagaggcuaagaccccauuugcacugagcccuucc

SEQ ID NO: 2241674 - RNA, 71 nt, Homo sapiens
gggacccccagaguuucugauucagcaggucuaagaugggaccugagaauuuacaauucuaucagguuccc

SEQ ID NO: 2241675 - RNA, 69 nt, Homo sapiens
ugggaauaggcuugguaggcacgaucaguccaggaaauucuuuucagugccuucugagccuagucucca

SEQ ID NO: 2241676 - RNA, 71 nt, Homo sapiens
auccugaccucccagagcaacccagggccagccacucccgcugccuacugguuguucugggcacuggggau

SEQ ID NO: 2241677 - RNA, 129 nt, Homo sapiens
gguuacagguuuuacuauuuauugcuuauagaagcagcccaaaugcuucuauggacugucuuuuccccugcagacacucccacagaagcauuuggggcacuggcuuaacagcaagguuacagguuaacu

SEQ ID NO: 2241678 - RNA, 77 nt, Homo sapiens
gaauuucaaauauauuucuagucauugucuacuguuaucacaugcuuagaguuuuacuagagaugcauuuguaguuu

SEQ ID NO: 2241679 - RNA, 71 nt, Homo sapiens
ucaaguagcagaacauguuccuuguaaaugcuaaaccauaacagcuauagaucaugugucugcccuuuuga

SEQ ID NO: 2241680 - RNA, 91 nt, Homo sapiens
ugcaaugugagaaagacaugaaauuuggggggccaggguagaaugauaugguuucgauguuuguccucuccaaaucucauguagacaugua

SEQ ID NO: 2241681 - RNA, 89 nt, Homo sapiens
gaggaaauagaaguugagagaguuuguaauuugcuccaugcuacacaguugguaacuggcauagccagacuucucacucauguuuucuc

SEQ ID NO: 2241682 - RNA, 99 nt, Homo sapiens
aagauuaauauuuccauagugagacaugugaauauuuguacuagguagaauguggaauaaguuaaauaaccucauguccguuggaaaauuguugguuuu

SEQ ID NO: 2241683 - RNA, 57 nt, Homo sapiens
uucuacaucagagacuucauacuggugucaaaccuuaugaauguaaagaauguggga

SEQ ID NO: 2241684 - RNA, 83 nt, Homo sapiens
gcugcuuggaaggcugaggcagugaggcagaguuugcaaugagccgagaucgcaccauugcacuccagccaaacuacaagagc

SEQ ID NO: 2241685 - RNA, 64 nt, Homo sapiens
auagauguagauuuacuuccugugacuuugcagauagaguacaggcaaguuagucaucauuuau

SEQ ID NO: 2241686 - RNA, 92 nt, Homo sapiens
ucuuccuauauuguacugcuacugguucuguuucuuugguugaauccuaacugauauaaaagggaucauaggaaguacaaucgggcaauaga

SEQ ID NO: 2241687 - RNA, 70 nt, Homo sapiens
ugauuugggaguauugcuugagcccaggaguuugagacaagcuugggcaacacagcaagaccccaccuca

SEQ ID NO: 2241688 - RNA, 59 nt, Homo sapiens
auuucuccuaggaguaucaauacaagguguugacaacugauuaacuccuuuagagaagu

SEQ ID NO: 2241689 - RNA, 76 nt, Homo sapiens
gcuagugggccuuauuuccugugugaaacaacuuuuaucaaaauguauuugacacugggagugugggugaacuggu

SEQ ID NO: 2241690 - RNA, 75 nt, Homo sapiens
guuccuucaagaugccaucuuuauuucugaaucccccaugcccugugugaugacauucagagaugaaggaggaac

SEQ ID NO: 2241691 - RNA, 82 nt, Homo sapiens
gauuaauuuguugagaaguaguauguuuauagcauugaguccuacgauucauaauauauauggcauauauuucaguuuaguc

SEQ ID NO: 2241692 - RNA, 90 nt, Homo sapiens
gagaacuauuggugcagaacuaguguggaacuuuggaaguaagaagacccucuggcuuugugaguugccagacauuuugugcugguucuu

SEQ ID NO: 2241693 - RNA, 71 nt, Homo sapiens
ggugguucuuauggucaggcaaaugguuuaggggugcuuguucuuaaacuugucuaauuauaagcaucacc

SEQ ID NO: 2241694 - RNA, 59 nt, Homo sapiens
agcuauugucagcaggcacaugagucaguuaaauaauuuaaagcuuagcuauaguggcu

SEQ ID NO: 2241695 - RNA, 68 nt, Homo sapiens
gaucccugagcuuguuuuccugcaacuagauggucccaucugggggugaugggagacagugauagauc

SEQ ID NO: 2241696 - RNA, 90 nt, Homo sapiens
agaacagugccuggcauauaguaggugcucuguguuugauaaauuuauucaacauuuauugagcaccuacuggaugccagaugcgguucu

SEQ ID NO: 2241697 - RNA, 59 nt, Homo sapiens
gggaacagaaauguccuuaaaagcagguugcuaaaugcaacugauauguuccuguucuc

SEQ ID NO: 2241698 - RNA, 117 nt, Homo sapiens
uaggauucuaugaucuacaaacagcaacuguugaccuauguuucuucaucugaagaaauccauaauuuuagauucagauauuuaggacaauaugcuagaauguucaugguaugccug

SEQ ID NO: 2241699 - RNA, 70 nt, Homo sapiens
uuagauuggugcaaaaguaauugugguuuuggcugaaaaguaaaugcacaaagauuuugcacuaaucuaa

SEQ ID NO: 2241700 - RNA, 71 nt, Homo sapiens
aauaaagcaugaggcauuuaucauuucaugagucaucuugacauaaaaggauaaaugccucaugcuuuauu

SEQ ID NO: 2241701 - RNA, 95 nt, Homo sapiens
gacagagucucguucuguugccuaggcuggagugcaguggcgugaucucagcucacugcaaccuccgccucccggguucaggcgauucuccuguc

SEQ ID NO: 2241702 - RNA, 67 nt, Homo sapiens
gcaaacuuuuuacucaaugauuccucugauaacaaguuaugggagaaccauuuggagaaaaaguugc

SEQ ID NO: 2241703 - RNA, 76 nt, Homo sapiens
ucgcuugaacccaggagcuggagguugcagugagccgagaucgcgccauugcacuccagccugggugacagagcga

SEQ ID NO: 2241704 - RNA, 72 nt, Homo sapiens
auaagaugagcagacuguaucaaugucaguauugugguugugauacuguacugcaguucugcaaaauguuau

SEQ ID NO: 2241705 - RNA, 69 nt, Homo sapiens
auuucuuccgcuguucuugucauuugccuguuuuuuucuagaggauuguugccugacacuggaagaaau

SEQ ID NO: 2241706 - RNA, 62 nt, Homo sapiens
cagaguugauggaguacacuacaggaagagcccacuguguuugugacacucguuaaccucug

SEQ ID NO: 2241707 - RNA, 68 nt, Homo sapiens
ugacucuagcuggagugacaaggaugacuuggcucugcuuuagguauuuuuuauccuccagcagguua

SEQ ID NO: 2241708 - RNA, 72 nt, Homo sapiens
ugacuccauuucuccucauuuacaauaaaucaguguuucugcagcuggacuugauaaaugaauaauggauca

SEQ ID NO: 2241709 - RNA, 60 nt, Homo sapiens
uuauuuggucuguaauuacauggacuuuauuuggaggucagugaaggaacaacuaaauag

SEQ ID NO: 2241710 - RNA, 103 nt, Homo sapiens
ggcugaggugggaggauugcuugagccaaggaauuugaggcugcagugagcuaugauagugucacugcacuucaggcuuucucuuggggucucucgcguggcu

SEQ ID NO: 2241711 - RNA, 73 nt, Homo sapiens
gaggaaagaugagugagagcaucaacuucucugacaaccuaggccaguaaguagugcuugugcucaucuccuu

SEQ ID NO: 2241712 - RNA, 61 nt, Homo sapiens
gggaagccaugcucagagguacaucucuaugcucuuucuaccucuaguaauaaaguuuccc

SEQ ID NO: 2241713 - RNA, 67 nt, Homo sapiens
ucccagugcuaugcaaaagccugacagugaugacuaaaaagcuacaggcugucacguaacacugggg

SEQ ID NO: 2241714 - RNA, 64 nt, Homo sapiens
cagcaagucucuaagaguucauaaugcuauuccgcugggaagugacuuacucuagagaaugcug

SEQ ID NO: 2241715 - RNA, 105 nt, Homo sapiens
cucccagggccuguuaauggauuuugaacuugagaguuggcagucaaauggcccaggaugccagcugcucaguuauuagacauuuagggaagaagcaaugaggag

SEQ ID NO: 2241716 - RNA, 80 nt, Homo sapiens
ugaagaucagauaguuguagguguguggccuuauuucuggguucucaauucuguuccauucaucuaugugucuguuuuua

SEQ ID NO: 2241717 - RNA, 84 nt, Homo sapiens
uuugagaccagguuaugaaacuggcuaauuuuuguauuuuuguuaaauaccgaaauucacuguguugccaaggcuggucucgaa

SEQ ID NO: 2241718 - RNA, 57 nt, Homo sapiens
acaaguauuggugaggauguaggauguagagaaaucagaguucccaccauugcuugu

SEQ ID NO: 2241719 - RNA, 70 nt, Homo sapiens
cuagugcugacugaggaagcgcucucuccugggccuggcuuccaaggagggggcuuccucggaguccugg

SEQ ID NO: 2241720 - RNA, 95 nt, Homo sapiens
cuagcuuuguauauauacuucauguuagugaaauccugcaguacuagucuguuuguaacuggcuuauuucacuuagcauaaguccucaagguuag

SEQ ID NO: 2241721 - RNA, 92 nt, Homo sapiens
ucugcuacacaugcaggcucccugcccucugaagcacuuuuuagauacaaaggcaggugaccaccuguauguaccccaaagacuguggcaga

SEQ ID NO: 2241722 - RNA, 86 nt, Homo sapiens
uuccauuaaagucugaucccuuuuuuaaauagcuguuuggcuaaucuguugugguagacacuguugaaaaggccccacuuucggaa

SEQ ID NO: 2241723 - RNA, 55 nt, Homo sapiens
cagcuggugggagcuggguucccaagggcaggggaaccaccagcucucccagcug

SEQ ID NO: 2241724 - RNA, 77 nt, Homo sapiens
ccuauuuccugcaaauuggcagauggauccagaaguuggaucacacucaccuucuguccuuuuggcaggaccagagg

SEQ ID NO: 2241725 - RNA, 81 nt, Homo sapiens
uccccuuuacccaacacagauggauuuuguaggcugaucaugguaaggucaaaugcacagaaccauuaaggguugggggga

SEQ ID NO: 2241726 - RNA, 84 nt, Homo sapiens
auaaauucucagugguugauuuauuuaucuuugccucuauugcaauaugagcagguagauggaccauuuuacaccuaaauuuau

SEQ ID NO: 2241727 - RNA, 65 nt, Homo sapiens
ugcauaaagcacuuuuuucugcauggcauaagacaauggucgucucaaggaaaagugcuuuugca

SEQ ID NO: 2241728 - RNA, 55 nt, Homo sapiens
ucuggaauauuagcuggucuuaacuaggcaaaguuggacaaaagaauauuccagg

SEQ ID NO: 2241729 - RNA, 72 nt, Homo sapiens
cucagggucccaaugguacuggggucccggaguugaaucgaagcuccugaaaauccagacugggggggugag

SEQ ID NO: 2241730 - RNA, 78 nt, Homo sapiens
uuguguuaagcuauauugaggaugccauucaauaauuacuuuaaaaugcauggcgacuucaaauaugaaggaacacaa

SEQ ID NO: 2241731 - RNA, 57 nt, Homo sapiens
gcuggggaguggggugggucccugaagaccucucaaggacacugaacacuucccagc

SEQ ID NO: 2241732 - RNA, 57 nt, Homo sapiens
cuuuacacauccuaaccaguguccaggaugauuccagcacaggggaggagugugaag

SEQ ID NO: 2241733 - RNA, 62 nt, Homo sapiens
caaacagaaguuuuaucuauauuaaugacaacauuuauuagguuaggcaaacuucuguuuug

SEQ ID NO: 2241734 - RNA, 56 nt, Homo sapiens
gucaguuuacaugagcguguugaguuugggaaaauucaucaagcuguagacaugau

SEQ ID NO: 2241735 - RNA, 56 nt, Homo sapiens
gcuuugggucccaggaagggggcacugaagcgauccucuuuuuguggccccagagu

SEQ ID NO: 2241736 - RNA, 87 nt, Homo sapiens
uccguucuaugucucucauuuuccuccuaugggagcccagacacauucuucucauggugauggcaaaaucacaagacaguagacgga

SEQ ID NO: 2241737 - RNA, 65 nt, Homo sapiens
uuuguucugguaucagcaauuucuguucuuguucuaacaggguggugccugguccauucaacaaa

SEQ ID NO: 2241738 - RNA, 81 nt, Homo sapiens
ggcccaguaacaacuagguuuuuaaaauccagaaugaggcucugcgguucaccuggagacaugaagacugggucuggcgcc

SEQ ID NO: 2241739 - RNA, 79 nt, Homo sapiens
caucuguuuauuuucauggcgaggcuucauggggacgggaacaaguccuugaugagcgccugccagagcugggcaggug

SEQ ID NO: 2241740 - RNA, 63 nt, Homo sapiens
cuaccuggguggcucaugacuuuggguaagucccuuucuuccucaugagccaaccauggauag

SEQ ID NO: 2241741 - RNA, 66 nt, Homo sapiens
gaugugauguguuuaucacccaguccuccauuuuuuuggagggggcaguacagagcacauccuguc

SEQ ID NO: 2241742 - RNA, 71 nt, Homo sapiens
gggauaagaauaucauucagaaagacccuuaacaaaacuuacaguuauggguuucagagggugauaguccc

SEQ ID NO: 2241743 - RNA, 74 nt, Homo sapiens
ccuggugugguggcucaugccugccuucucagcuacuugggaggcugaggugggaggauuggcuugagcccagg

SEQ ID NO: 2241744 - RNA, 129 nt, Homo sapiens
cuccugaucucaggugaucagccugccucggccucccaaagugcugggauuaggccaggcgcaguggcucaugccuguaaucccaguacuuugggaggccgaggcgggcagaucaccugaggucaggag

SEQ ID NO: 2241745 - RNA, 72 nt, Homo sapiens
gcuucauuuggguaguugguaacaugcauaugcuugggguggaugacugagacuaacuuacuuuccagaagc

SEQ ID NO: 2241746 - RNA, 58 nt, Homo sapiens
ugaugcuuggcuuccaaucccagacacugauuuuguaugagaugugaccagggcauca

SEQ ID NO: 2241747 - RNA, 56 nt, Homo sapiens
gaagccagagugagcaugaaacucuuccugagaaagacaugugcacuacuggcuuc

SEQ ID NO: 2241748 - RNA, 67 nt, Homo sapiens
ugucagguuauugccaugcaaaagagugguaacuuccagguguugccauagcaaugguaagcugaca

SEQ ID NO: 2241749 - RNA, 129 nt, Homo sapiens
caauacaaucaccugcaggguuuguuaacagacagauggcugggucucacuccagagauucugauuuuguagaucuugggugggaacugagaauaugccuuuuuaacaaguccucaggugaugcuguug

SEQ ID NO: 2241750 - RNA, 89 nt, Homo sapiens
ggagaauugcuugaacccgggagguagagguugcagugagcugagaucgcgccauugcacuccagccugaccaacaagaacgaaacucc

SEQ ID NO: 2241751 - RNA, 70 nt, Homo sapiens
aacaacuagggggguuauuuugaggccacccauuaggccuuagaagcacuaucccuccuagugcaauguu

SEQ ID NO: 2241752 - RNA, 62 nt, Homo sapiens
aggguugaucuauguugcuggcaguuuggguguucagagugacagaaauuuagaucaaccuu

SEQ ID NO: 2241753 - RNA, 69 nt, Homo sapiens
cuggggauggggaagcuguuucuucugguaagaaaguuucaucagaguuuacaagcucaguguccccag

SEQ ID NO: 2241754 - RNA, 65 nt, Homo sapiens
ccuucucaccaucccacaguuugagagagacaguuuuucucacauuucacagggaugggggcagg

SEQ ID NO: 2241755 - RNA, 59 nt, Homo sapiens
aaaccucugccuagauuucagaggauacauggaaaugccugauguccaggcagagguuu

SEQ ID NO: 2241756 - RNA, 109 nt, Homo sapiens
agcaaacaaggugauaugaagugaacuauaugugugugaacuuccuucacagucaaccaccugagaaguaaauuuauuugcaaauggaaaacauguauuacuuuuugcu

SEQ ID NO: 2241757 - RNA, 65 nt, Homo sapiens
auuaaggcgauuguuuuuuccucaagggcacuuccuugagggcugaauaccaaucagccugcgau

SEQ ID NO: 2241758 - RNA, 77 nt, Homo sapiens
ugaaauacuuuguucagaucaagaguaguaauugauaaaugauauugcuuaugaugcugaauuaaauuuguauuuua

SEQ ID NO: 2241759 - RNA, 82 nt, Homo sapiens
gagacauaaaacuggcuagggucaaacgucaucuugaagguuuuuaaggaaagcauuuaauucagcggcagauuuaugucuu

SEQ ID NO: 2241760 - RNA, 98 nt, Homo sapiens
ugaaauauauauuuggucuuugccccccaguuccugacacagaguuccuaaaacucuugcaauuuccuuagugguggggugauaggaguaucuuuuua

SEQ ID NO: 2241761 - RNA, 73 nt, Homo sapiens
uugauaucugaugccuauggaauauaaggaaacaauaacauuuaauccaucauucugauaggcacaauaucaa

SEQ ID NO: 2241762 - RNA, 76 nt, Homo sapiens
uugaaaguccaggacuguuucagcugaaccagagggcacacaauuugcaucacugaaacuguccuggguuagucaa

SEQ ID NO: 2241763 - RNA, 75 nt, Homo sapiens
aauaauggagcugugauuugaguccagaucuaacaccacagauguucuuuccucuauguuacgguuccaguuauu

SEQ ID NO: 2241764 - RNA, 129 nt, Homo sapiens
gucucauuuaauccucaaaccacucugggagguagguauuagcuuuucaaagaugagaaaacagaggcuuugagagguuaguuuaugugcucaagaucccacagcaaguagguaaaauggagaagagau

SEQ ID NO: 2241765 - RNA, 63 nt, Homo sapiens
acuugccaauauauauuugcuacaaaugcuacaaauauuuguagcaaauauauuuuggaaggu

SEQ ID NO: 2241766 - RNA, 112 nt, Homo sapiens
auauauugcuuuacaaggauuaugugaggauaaaugcaaugguauuuuugacauauuauaguacucaagaaauuguaguuauuucugcauugaauuuuuggauguuuugugu

SEQ ID NO: 2241767 - RNA, 99 nt, Homo sapiens
uucaggcuuuuuuugguuccauauggacuuuaggauagcuuuuucuaauucugugaagagcaucacugguaguuugauaggaauagcauugagucugaa

SEQ ID NO: 2241768 - RNA, 65 nt, Homo sapiens
auugcauguucuuacucauacaugggugcuaaaaaauguguucauguggauguagagaguggaau

SEQ ID NO: 2241769 - RNA, 61 nt, Homo sapiens
uaugagauuauuuaaaaggugauuuuccuaacaagggaaaauuugaaaccuauaauccgua

SEQ ID NO: 2241770 - RNA, 78 nt, Homo sapiens
ucugaaauucaaaguagaaaaggggcaauuccaacccucucuuggguuccaaaguuccccuuuccuaucuuaguuaga

SEQ ID NO: 2241771 - RNA, 69 nt, Homo sapiens
gucucugacuuccugcuggugccaggagugagucgugggaaaugcuucauuggccaccaggaaggagac

SEQ ID NO: 2241772 - RNA, 57 nt, Homo sapiens
cagauuguagcaauugaguacaggauauuccugugaacaaaauuuguugcauauuug

SEQ ID NO: 2241773 - RNA, 59 nt, Homo sapiens
cugaugaugauguucacaaugaugaugauuacuauagccuugugagcauuagcauuuag

SEQ ID NO: 2241774 - RNA, 67 nt, Homo sapiens
ugaauuuuaucaaaggccuuuucugcauuugagauaaucaugugguuuuugucuuugguugaguuua

SEQ ID NO: 2241775 - RNA, 122 nt, Homo sapiens
cuccuggcaggguuaaagggagaguacuuuaaacccauauaccagcugugcuucaguuucucucacuuugcccuggguaagcugcuguagggucagaaguaacccuuucugugccaguugag

SEQ ID NO: 2241776 - RNA, 98 nt, Homo sapiens
gggacugugcaggagaaguuuugaugcacuuguaggacauuaguguuccaugagaugcaucaaagcugccucugcuaaaacugaaaauggguggucuc

SEQ ID NO: 2241777 - RNA, 60 nt, Homo sapiens
aagugaccuguaguuuaguugccuguaguuuaccugccgccacuauuacacagggaacuu

SEQ ID NO: 2241778 - RNA, 63 nt, Homo sapiens
uaagguccuccugaagaacaaggcuugcagcagacaggagucagguaguuucagaggaccuug

SEQ ID NO: 2241779 - RNA, 74 nt, Homo sapiens
ugcaucagugacugggccuagaguuagcagaauuacaggaugguugagcaagcuuuggagccuaacucuaugcg

SEQ ID NO: 2241780 - RNA, 69 nt, Homo sapiens
ccaguugaaaagcugguguugcugcucuguucucucuccaugagagcggugcacacuaccagcuucugg

SEQ ID NO: 2241781 - RNA, 78 nt, Homo sapiens
ccuucauuugaucacaguuauaacauccuuuuugccauguaagguaaccagggauuagaacguggucauauuugaggg

SEQ ID NO: 2241782 - RNA, 86 nt, Homo sapiens
uaaguucuaggguacauuuacacaacgugcagguuuguuacauauguauacaugugccauguucgugugcuguacccauuaacuug

SEQ ID NO: 2241783 - RNA, 77 nt, Homo sapiens
gucugacuggguuaauuugaagguugaguguuugagcucugaaauucuuucuucugcuugaccuagucuguuuaggc

SEQ ID NO: 2241784 - RNA, 79 nt, Homo sapiens
cagacuggggagagaaaucaaaaccugaacaccaauauggcagugaguuuacugguuuuauauauuucucccaaaucug

SEQ ID NO: 2241785 - RNA, 77 nt, Homo sapiens
ucacuugaacccagcaggcagagguugcagugagcugagaucacaccauugcacuccagccugggggacaagaguga

SEQ ID NO: 2241786 - RNA, 59 nt, Homo sapiens
uaauguuaguuuuccauacaugguuaucuuuuaaggauagcaguaagaaacugacauug

SEQ ID NO: 2241787 - RNA, 63 nt, Homo sapiens
ugguaguggauguucagagauuugaacccaggugucuggcuucagagucugugcauucugcua

SEQ ID NO: 2241788 - RNA, 63 nt, Homo sapiens
caguugcuuguggcuagugcauagaaauaaguggauuuucugcacaucgaucacaagauucug

SEQ ID NO: 2241789 - RNA, 102 nt, Homo sapiens
ucucuccaggcauuguuguucuuguuuguuggggcuauuugucuauuuguuuaguaauuuuuccaaagugguuuuuacaaagacagaaugaucuggcaggga

SEQ ID NO: 2241790 - RNA, 60 nt, Homo sapiens
ggcagcuuucuguuuagucuggcagugaccaaacgggccugcaagaaucaggaagcugcc

SEQ ID NO: 2241791 - RNA, 85 nt, Homo sapiens
uaaccaaagcaucaugauuagaacagaagucagauuacuugggagugguuugauaaaucuguguuaaauugaaaaguuuugguua

SEQ ID NO: 2241792 - RNA, 60 nt, Homo sapiens
uggcaacuacuaaucauuuaacuuuugguuguaagggcuuagauguuuagaagugggcca

SEQ ID NO: 2241793 - RNA, 56 nt, Homo sapiens
uuaguucucauccauucagucauguauucauucauuauggcaugaaugugaacuaa

SEQ ID NO: 2241794 - RNA, 69 nt, Homo sapiens
gcuaaucuagccuuauaaguauuugaaggcaauaaucagaccuuaagaauaaguaggaguuagguuagc

SEQ ID NO: 2241795 - RNA, 82 nt, Homo sapiens
uuggugacuugucaagucuuuaauuguccuuuguuuucuccucuggggaugagcugaaagagacauugcuccaacucaccaa

SEQ ID NO: 2241796 - RNA, 74 nt, Homo sapiens
uacuaagugaguauaauuuuaagagggauaauguuauuuugcccaagauauuuuuaaaaggugcauacuuagua

SEQ ID NO: 2241797 - RNA, 60 nt, Homo sapiens
gagaaugaugauuuccaauuucauccauguccccacaaaggacaugagcucaucauuuuu

SEQ ID NO: 2241798 - RNA, 60 nt, Homo sapiens
ugugauuaaguuaacaauguugaguggugggauuauucacaugggugcaauauaaucaca

SEQ ID NO: 2241799 - RNA, 76 nt, Homo sapiens
ccaaguaaaugguguuuccguuaagcugaacuauaaaauguggguuacuuaaacagaaaugcagaaaggcacuugg

SEQ ID NO: 2241800 - RNA, 85 nt, Homo sapiens
ccaccgcuacccagcuaugucuuggagaauccuggguuuggucaaagccaguuucucccagaggcucagggcuggggggaggcgg

SEQ ID NO: 2241801 - RNA, 74 nt, Homo sapiens
uucuuaauggcaucuagaguggugaaucuuuuccagaagguuuuuaauuuacuuugcucagauccaucagagga

SEQ ID NO: 2241802 - RNA, 63 nt, Homo sapiens
cuauguguccauguguucucaucauuuagcucccacuuaucagugagaacaugugguauuugg

SEQ ID NO: 2241803 - RNA, 100 nt, Homo sapiens
uugugacacauuuaaagugcuaccuaauccugugguagcacucaaaguccuugugacuuugagcucugaaugacaggcauaagguuaacacuggucacga

SEQ ID NO: 2241804 - RNA, 71 nt, Homo sapiens
gcuuuuuuuuagaguaagauuuuaccacugugggaaaaacauagcuguuuaauacucuagguuaagagagc

SEQ ID NO: 2241805 - RNA, 82 nt, Homo sapiens
caaaaacucuaugaaaguuccuaauguggcuaucuaguguauuccuaacauaggcacauuaggaacuuuuguagaguuuuug

SEQ ID NO: 2241806 - RNA, 62 nt, Homo sapiens
gaaaaaggcuggcaugcuggcaugcacacaccccugucauccccugcaccaaccuuuacuuc

SEQ ID NO: 2241807 - RNA, 108 nt, Homo sapiens
gauucuuagaccaggaauauuugcucacaaucaauuaucaaucacuuaauauauaucugauaauguuugauugagcagauagauaugccagguuuccuagagagaguc

SEQ ID NO: 2241808 - RNA, 69 nt, Homo sapiens
auaggucuuuuagcauaggagcuacugagacuacuuuucuucucacagcucacugcugaaacagcuuau

SEQ ID NO: 2241809 - RNA, 88 nt, Homo sapiens
acaugcuccugcccaugcuuagcccagugggugcuucucuuccuggggccagcaggaaguccgcuuggcugguggggcaguggcaugu

SEQ ID NO: 2241810 - RNA, 58 nt, Homo sapiens
uccuucauucauuaauuuagcccuggacccagggcugacuccuauuggaugaacugga

SEQ ID NO: 2241811 - RNA, 84 nt, Homo sapiens
gguuuauaucaaguuucauggcucaguauaucuugggaauccagugugaaucaaguacugggcuauggauauuuaagagggauu

SEQ ID NO: 2241812 - RNA, 57 nt, Homo sapiens
ggaauuccauaguacagugaugaguguuacauacuuauaagagugcuauggggaucu

SEQ ID NO: 2241813 - RNA, 76 nt, Homo sapiens
cagauggcugccaucuugcugaguguucacaugaccucuuuaugugagcacugaaagaaggcaagugaacuuucug

SEQ ID NO: 2241814 - RNA, 100 nt, Homo sapiens
auaauuuaugaauaguguaucuccucuuugcuuugaucaaguguucuuuaaaagccaagacuaugugaugaaggcauagggaugugaugucaagaguugu

SEQ ID NO: 2241815 - RNA, 105 nt, Homo sapiens
ggggaugguuggcggaccugcggagaaagauaaugguaauugauggaaucaaagucgcagcacagccuuguguuuucuuggcaauuaauucccccaccccucccc

SEQ ID NO: 2241816 - RNA, 101 nt, Homo sapiens
ugagagggagucucacucugucacccaggcuggagugcaguggcacgaucucggcuaacugcaaccucugccugcugguuucaagugauucuccugccuca

SEQ ID NO: 2241817 - RNA, 64 nt, Homo sapiens
cacuuuuauuuguguuucuauuucuguccgaugagaguggacuggaguauaaggcaaaggagug

SEQ ID NO: 2241818 - RNA, 66 nt, Homo sapiens
gguggcuuuuugugauggcugacuuagucugaauaaccugcuaugccauugucagaaagggccauc

SEQ ID NO: 2241819 - RNA, 97 nt, Homo sapiens
auauguuuuuagugcauaucugugguuggcugaauaagggcccccaaaagauagucaugcccuaaucugcagagccgauggauguuacuuuauaugu

SEQ ID NO: 2241820 - RNA, 59 nt, Homo sapiens
ugcaccaucuugcuucuguggucaggugaagaagugaacagggagguggugguggugua

SEQ ID NO: 2241821 - RNA, 55 nt, Homo sapiens
ccucuuuguugagacuucaccaaaugguucucaccaaugguucucaacagagggg

SEQ ID NO: 2241822 - RNA, 66 nt, Homo sapiens
ccuucuucaugagacuuuuggaaggcuuuuuuuugguggaagccaaucauugaucaugaguugagg

SEQ ID NO: 2241823 - RNA, 95 nt, Homo sapiens
uuuaucuuguuugagcuacacugauucauuuguucauuuucugucucuuauuuucaguugaacuuuaucggaacagguacucauaacaagaugag

SEQ ID NO: 2241824 - RNA, 92 nt, Homo sapiens
uuguuuuaccacuagcuuugcagagacuuguuaggaauuuacagcuugugauugcuucacuuuuuuggaaauggcucuaugguuucaaacaa

SEQ ID NO: 2241825 - RNA, 97 nt, Homo sapiens
ugaggcaggagaauugcuugaacccaggaagcagagguugugguaagccgagaucaugccauugcucuccugggugacacagcgagacuccaucuca

SEQ ID NO: 2241826 - RNA, 59 nt, Homo sapiens
uauuugguuugccauuccaagguguggagcuauucuacacuugcugaguaaaucaaaua

SEQ ID NO: 2241827 - RNA, 55 nt, Homo sapiens
uucaugagggcggacgcccuggagaguguggcugcuccagcccagcccucgugga

SEQ ID NO: 2241828 - RNA, 60 nt, Homo sapiens
cuuugcccauucaggguuucuuggagcagccccuccacaguagucuugggaugggcaggg

SEQ ID NO: 2241829 - RNA, 58 nt, Homo sapiens
uacuuagagacaugcagcacuguagcccucaguggugagguuugcagguacucaagua

SEQ ID NO: 2241830 - RNA, 81 nt, Homo sapiens
aauguguaauuggauuguaacauagaguaaaugcuugagggaguggauaccccauuuucuauguuguaauuguuacauauu

SEQ ID NO: 2241831 - RNA, 55 nt, Homo sapiens
gcacuguugauaacauuagaaaguuugguuuucaagcuuguguguaucacagugu

SEQ ID NO: 2241832 - RNA, 111 nt, Homo sapiens
acuuccugcucuucugugucuuuuauuucguuuguaauccuuacagcaucucuagugcaguggaugauaauaaaugcugaugaaaagaaacccuucacaagcuaaggaagu

SEQ ID NO: 2241833 - RNA, 69 nt, Homo sapiens
ggcuuuugagaagguuaauuagauuugaaggcggaggaagcagaagucaaggaggccuuucagauggcu

SEQ ID NO: 2241834 - RNA, 76 nt, Homo sapiens
uuacuagauuugaagguugaucucaugugucaacucagaggguguuuuugggugagauuaccauuuaaaucaguga

SEQ ID NO: 2241835 - RNA, 74 nt, Homo sapiens
guaauuuggggucuuugaaauuuauaugagaccauuuuucuggucuuacaugcaugacaaggugccaugauuau

SEQ ID NO: 2241836 - RNA, 67 nt, Homo sapiens
agcugaucgcuuuuauguuuaauuuuguuaauaggauuuucuguacacaguaaacuaaaagcuagcu

SEQ ID NO: 2241837 - RNA, 97 nt, Homo sapiens
ccaugucuggaggccaggaggggaggauggggucuguugagggccgcacugcauucccucgagaaaccaucugcugaaggccugaccuccagcaugg

SEQ ID NO: 2241838 - RNA, 82 nt, Homo sapiens
gugcagcuagacuguaagauccaggagagcaagaacuuugucagccucgcucucugugcaucuucaguuucuacaacagcac

SEQ ID NO: 2241839 - RNA, 55 nt, Homo sapiens
ggugcagugugauuuucuggcugaguggugucugccucagucauauaucugcacc

SEQ ID NO: 2241840 - RNA, 129 nt, Homo sapiens
uuggccucccaaagugcugggauuacaggcaugagccaccaugcccugcuggucugaugguuuuagaaaggagaguuccagccgggugcaguggcucacaccuguaaucucagcacuuugggaggccga

SEQ ID NO: 2241841 - RNA, 118 nt, Homo sapiens
uaucuagcugauauuuacugucuaguaaauaucuagcugauguuugucuaguagcaaacauguuguuauugaccaauaguaguuugauauuuacucucuaguaaauaucuagcugaug

SEQ ID NO: 2241842 - RNA, 68 nt, Homo sapiens
ggugccaggaguaacagcugaugucuugcuuaacaaagcagcuugucuuauacuacuucauuggcacc

SEQ ID NO: 2241843 - RNA, 67 nt, Homo sapiens
ggcuuauuaagucacacuagacaacugagguugccuaagacgucauugucuuggacuugcaagggcc

SEQ ID NO: 2241844 - RNA, 70 nt, Homo sapiens
aagucuuugcuauugugaauagugccgcaauaaacauacgugugcauaugucuucauaguagcaugauuu

SEQ ID NO: 2241845 - RNA, 73 nt, Homo sapiens
cacagagguagagacuauguauuagagaucaaaacccuuuccuuucuuuauucaguguccucuugccauugug

SEQ ID NO: 2241846 - RNA, 67 nt, Homo sapiens
cuggagaauguuccacauacauuuaagaagacuucauuuuuuuagugcugaguggaauguucuauag

SEQ ID NO: 2241847 - RNA, 78 nt, Homo sapiens
ugguuuuugucguugguucuguuuauaugcuggauuacauuuauugauuugcauauguugaaccagccuugcauccca

SEQ ID NO: 2241848 - RNA, 73 nt, Homo sapiens
gugugccaucaaaguaucucaauaugguagaauuuuuucuccuuuguggaaauacuuguggugccauguacau

SEQ ID NO: 2241849 - RNA, 74 nt, Homo sapiens
gguuggugcaaguguaauugugaucuuuucccuuacuuucaaugccaaaaaucacaguuacuuuugcaucaacc

SEQ ID NO: 2241850 - RNA, 102 nt, Homo sapiens
ugaggcaggagaauugcuugaacccgggaggcagagguuguagugagccaagaucacgccacugcacuucagccuuggggacagagugagacuccagucuca

SEQ ID NO: 2241851 - RNA, 58 nt, Homo sapiens
ugauggaagaagccaaguuuccugaguggccacuaggaaaacucugucuucuuuauca

SEQ ID NO: 2241852 - RNA, 55 nt, Homo sapiens
acucuaacacugagcaaagaaaauuagaauauuuucaugucuuggcuguuagagu

SEQ ID NO: 2241853 - RNA, 88 nt, Homo sapiens
aacagccauccguuaaaucuaggcucuguguggacuugagguuuaucccagaucaucuugagcuuaggaauuuggauuugagucuguu

SEQ ID NO: 2241854 - RNA, 67 nt, Homo sapiens
acuuggggugugagggagaaagaaagaggguguuccccccuuuucuuuucuaucuccauccccgagu

SEQ ID NO: 2241855 - RNA, 72 nt, Homo sapiens
gucccuugggcauugcuauaaauucuuuuccuccacagcgggaguggguuuguaagauguccgggcagggau

SEQ ID NO: 2241856 - RNA, 55 nt, Homo sapiens
ccagugaacugcaagguuuuucccacuggcuggugagaaugugaacuguuccugg

SEQ ID NO: 2241857 - RNA, 112 nt, Homo sapiens
gcuuguggcccugguuuuccaucaggugaccugagccacuauggguuaccccuuccauggcaucuguguggccuccaagguuccugaagagcagacaucuugggccaugggc

SEQ ID NO: 2241858 - RNA, 66 nt, Homo sapiens
ugcuguacuucaagugucuuuaacucacauagucaauaugcuagagaaauauauuuggggauggca

SEQ ID NO: 2241859 - RNA, 72 nt, Homo sapiens
gguuauucauugugcuaaaguaauaagucagcucauccuuugauuuuaucuguuguuuuaguacaauugacc

SEQ ID NO: 2241860 - RNA, 72 nt, Homo sapiens
aggaaugcuuuuacauuguuagugggaguauaaauuaguugaaccauuguggaagacaguguggcaauuccu

SEQ ID NO: 2241861 - RNA, 57 nt, Homo sapiens
ggauauccuuguuaauauucugacuuguugaucugucuaauauugacaguggugucu

SEQ ID NO: 2241862 - RNA, 85 nt, Homo sapiens
uccaagucuuugcuauugugaauagugcugcaauaaacauacaugugcaugugucuuuauagcagcaugauugauaaucuuuggg

SEQ ID NO: 2241863 - RNA, 62 nt, Homo sapiens
uaucucauccuccuugaucccauccccaucaaaacuagagauugaaauaaggagaugagaug

SEQ ID NO: 2241864 - RNA, 77 nt, Homo sapiens
gauaugguggcuuaucuuuucgauaugcuguugguuugguuagcuaguauuuuguuaaggauuuuugcaucuauguu

SEQ ID NO: 2241865 - RNA, 57 nt, Homo sapiens
gguuuuagggugggugucauuggacuuaugucauccaaugagcucaucuugaaaacc

SEQ ID NO: 2241866 - RNA, 82 nt, Homo sapiens
gguuauaucacagcaaggacccauuauucuaacacaauaguaagaagacaaaauggugguucauuguuauggugcccaaacc

SEQ ID NO: 2241867 - RNA, 89 nt, Homo sapiens
ugugaagauaaaugaguuaauauguauaaaguguuuaguauaggcaaaccuuguuuguuuuauuccacuuugcuucauugugcuucaca

SEQ ID NO: 2241868 - RNA, 101 nt, Homo sapiens
gcugccugggcuuuuggcacaucuugaucuuuaguuacagagagucaggacaagacugagaucuuuuguggcugagaaacgauucaagggcugggugcagu

SEQ ID NO: 2241869 - RNA, 128 nt, Homo sapiens
agugugauaaauaagaaaaaacaugggccuguaagacacagugacaugggaucaaaucugauuguggcuacaauuacugguuaauuuccaguuacugcucccaaccccuccauuccauucucuacacu

SEQ ID NO: 2241870 - RNA, 58 nt, Homo sapiens
agucauuguugagauggugucagccuguacuucagauggacacuaacucaagauggcu

SEQ ID NO: 2241871 - RNA, 66 nt, Homo sapiens
agagguuuaacuggcuuaugguucugcaagcuauacaagcaugccacuagcaccuguucaacuucu

SEQ ID NO: 2241872 - RNA, 84 nt, Homo sapiens
aaguuaagggcuuuauuugaggucacaccgcuaguaagugauagagcugaggucugaauccagguaucauaguccgcagagcuu

SEQ ID NO: 2241873 - RNA, 77 nt, Homo sapiens
ugguaccuaguaggagggagguggagcaaaauggcaaauagaagccuccacugauuguccuccaugcaggaacacca

SEQ ID NO: 2241874 - RNA, 62 nt, Homo sapiens
uggcuggcuacauucacuuguaauaauguuucugagauucauacaagcuguagcacaugcca

SEQ ID NO: 2241875 - RNA, 99 nt, Homo sapiens
aaauagguccuaaauaaaggcugaugcaacugauaggcugaggccagaaaaaauucuuagcuaggcacugauaguuguauuuuuguuucuguucuauuu

SEQ ID NO: 2241876 - RNA, 109 nt, Homo sapiens
aacucuuaacaccaauuguuuacuuaucauuuauuuauuuuaagcaauuuuaguaggaacuauuggauagugauaagguagaugaugcaauauuuguuuuuuauggguu

SEQ ID NO: 2241877 - RNA, 78 nt, Homo sapiens
ggccuuugcauugcucuuagaaauauuucuugacaugugaacuugcauugggugacuaagagugugugugaaccagcc

SEQ ID NO: 2241878 - RNA, 56 nt, Homo sapiens
uggcgagaaaccauaugcuuucuugcuuagaaaagaaggcaagauguuuccugcca

SEQ ID NO: 2241879 - RNA, 128 nt, Homo sapiens
aggaggugcuugcauccuuccucuaaaguauaaugucauauaggguuuaccuguaugucaaaguauaaugaaauauaaggguuaccuuuaugucauuauacuuuggaggagggaugcaagcaccuccu

SEQ ID NO: 2241880 - RNA, 71 nt, Homo sapiens
auuuaaagaggacgucaaguguuuuuggaaauugaaauaaauuaccggaaugaaaauguccuucaguaaau

SEQ ID NO: 2241881 - RNA, 112 nt, Homo sapiens
auuguauuuugcaaugugagaaugacaugagauuugggaggggcuggggcagaaugauaucauuuggaucggugucccugcccaaaucucauguugaauuguaauccucagu

SEQ ID NO: 2241882 - RNA, 88 nt, Homo sapiens
uaagagaaagugacuugaggcaaggcugaaugaaggcauaaaucaagcgaugcaggccucauuggucuugcuggggauuuuugucuug

SEQ ID NO: 2241883 - RNA, 130 nt, Homo sapiens
ggcuauggcuccagcuauggcuguggcuauggcucugguuauggcuguggcuauggcuccagcuauggcuguggcuauggcucugguuauggcuguggcuauggcuccagcuauggcuguggcuauggcu

SEQ ID NO: 2241884 - RNA, 110 nt, Homo sapiens
auaucacggggggauguacaccaccugagauauugggaguaaugucaggcucucccuuuccuggauauuacgaacaauaucacagcguggguguacaccuccugcuauau

SEQ ID NO: 2241885 - RNA, 71 nt, Homo sapiens
aagauuagauggcugugcguggcuuuauuucuggauucucuauucuguuccauugcauacuaucugauuuu

SEQ ID NO: 2241886 - RNA, 74 nt, Homo sapiens
uuguguuuaaggaguagaauagaugcaccuucauucagaaaguggaaguuuaugaagucuaagccaaaacacaa

SEQ ID NO: 2241887 - RNA, 79 nt, Homo sapiens
aauuuauauguugaaauccuaacccccuaguaccucaaaaugugauguauuuggagguaggacuuuaaagaauuaaguu

SEQ ID NO: 2241888 - RNA, 76 nt, Homo sapiens
ucuuuugaauggagacauauguucuaagaacaaaagcacuuacagucauuuggaauauaaccuguuucuaagaaga

SEQ ID NO: 2241889 - RNA, 57 nt, Homo sapiens
uauguccugcuacucucucaugcugcauuuuugcucuugggaaauguccaggacaua

SEQ ID NO: 2241890 - RNA, 86 nt, Homo sapiens
aaggcaguuccuggauuaucaacaauuaauuuucacacaucccuuccacagaaacagucaauugcugaugaccugcagagcuccuu

SEQ ID NO: 2241891 - RNA, 92 nt, Homo sapiens
ggaucccuugagucuagaaguuggaggcaucagugaaguuauuuaauaugaucacaccacugcacuccagccugggcaauagagcaagauuc

SEQ ID NO: 2241892 - RNA, 111 nt, Homo sapiens
ggcaugguagcacaaaccuguaguuccagcugcucaggcaguuaaggcagaaaaaaugcuugagccuuggagugugagagcagccuggaaaacauagcaagaucccauguc

SEQ ID NO: 2241893 - RNA, 55 nt, Homo sapiens
ggcuaucuuagucuguuuugugcugcuaaaacagaauaccacagacuggguaguu

SEQ ID NO: 2241894 - RNA, 61 nt, Homo sapiens
ggugaauguguuauuuuuaaccuccauuaggaaaggagguuaguaguaguuugcauuuacc

SEQ ID NO: 2241895 - RNA, 59 nt, Homo sapiens
aagucaaggagagaggcgucagaagaaaugaaaucugcugacaccuugauuuuagacuu

SEQ ID NO: 2241896 - RNA, 81 nt, Homo sapiens
aucauugccaucacuagaucauagguaaacacuacugaaugcuucagacgugauuaccugggaucuagugacggcagugau

SEQ ID NO: 2241897 - RNA, 79 nt, Homo sapiens
gcuaguaaauguaugcuacugaccccuacuuacauaaaauauauucauguuagguauauaguuagaggugcauuuuggc

SEQ ID NO: 2241898 - RNA, 67 nt, Homo sapiens
cuuccugggcaaugcggcuggauagaccugagcaugucaguucuuuccacacuguaugcccaugagg

SEQ ID NO: 2241899 - RNA, 58 nt, Homo sapiens
ucacaguucagcauggcugaggaguccucaggaaacuuacaaucauggcugaacguga

SEQ ID NO: 2241900 - RNA, 120 nt, Homo sapiens
aaugaauuugcaugcuagagggaguguaaugguauuuaaagacccuugauuguucuagaaguugccugagaucuuuaagaacuacugcugcuuuacucuuucucagaugacagaauuauu

SEQ ID NO: 2241901 - RNA, 100 nt, Homo sapiens
uuaauaguuuugcuuuuuauacuuagcacguuagcauauuugaaguuuaugacaucaaguagugacucgaguuauuuuaauggaaagcaagucauguuaa

SEQ ID NO: 2241902 - RNA, 55 nt, Homo sapiens
ucacugugggcuuugaauccuguaaguaauuuaaaggcucaaaugcucccaguga

SEQ ID NO: 2241903 - RNA, 91 nt, Homo sapiens
uuuaaguauccaaugacuugagagcccauaacaucaugcccugugcaaugggcuaugacguugugggcucucaagccauccaauacuuaaa

SEQ ID NO: 2241904 - RNA, 65 nt, Homo sapiens
guaaguuguaguuagagaguugcuaaccaacuaggauggcaauugucagacaugcaguuucuuac

SEQ ID NO: 2241905 - RNA, 86 nt, Homo sapiens
gagcuaaguccaaugggcagaacagggccuccauucccucaauaccaagagagauggaacugaagugcugcccuuucuggaagcuc

SEQ ID NO: 2241906 - RNA, 80 nt, Homo sapiens
augagauguuuugauacagguauacaaugcauaauaaucacauuagaauacaugggguaucugugaucucaagcauucau

SEQ ID NO: 2241907 - RNA, 69 nt, Homo sapiens
cuugaggacgugaggaguauuuuuaggugcugaaugcagcccugaaauauuuccacggccacucccgag

SEQ ID NO: 2241908 - RNA, 109 nt, Homo sapiens
guaacuugaccaagagaucacacagcuuguaagggguagagccuggauucuaacucaggcaagcugacuuacaguccaugcauuauccuccacaaaaugcucagguuac

SEQ ID NO: 2241909 - RNA, 97 nt, Homo sapiens
gaggcaggagaaucgcuugaaccugggaggcagagguugcggugagccaagauggcgccauugcacuccagucucaccagggagauucccuuuccuc

SEQ ID NO: 2241910 - RNA, 79 nt, Homo sapiens
gaaguauuauuguacuaagugcauuuacauaaagcacuuauauguuugaagugugaugccuugaugugauaaauacuuu

SEQ ID NO: 2241911 - RNA, 82 nt, Homo sapiens
uugccuuugagauccauugcacuauggaaagugguuuuguggauaauacuuugcacguguaguguaauauuucacaagguga

SEQ ID NO: 2241912 - RNA, 100 nt, Homo sapiens
aagaaugaugauacccaauauugucuagguugaggguacaaggacauacucauggguacucuuuguguaggucaaucuggcaauauggaucaaaauucuu

SEQ ID NO: 2241913 - RNA, 92 nt, Homo sapiens
uuauuauuacucauuccauaauaacaaugccagaugccuaucagccgcaaacuaugagauaugcacuguuguuauuggauaaguugugauaa

SEQ ID NO: 2241914 - RNA, 58 nt, Homo sapiens
ggaugagguaauaaguccuuggaaaccucuuguuuccucagggaaaguugccccauuc

SEQ ID NO: 2241915 - RNA, 75 nt, Homo sapiens
ggguguacaccuugugauacuauuuguaauguucuagaaagauauuccuuuuaauaucacaguggguguacaccc

SEQ ID NO: 2241916 - RNA, 64 nt, Homo sapiens
gcagaacugaaguuucucugaagaagaagaaauucuaccuguagacuacagcuucagcuugugc

SEQ ID NO: 2241917 - RNA, 94 nt, Homo sapiens
uggauggguauaaggaagguaaauggaacauuauagauguaaaauuaugaauaagauauguacucguguaauguccccugccucagucccucca

SEQ ID NO: 2241918 - RNA, 64 nt, Homo sapiens
cacacaccggauucauggggaagaaguuaucaucgacggcuucuuguuuccugagucgguugug

SEQ ID NO: 2241919 - RNA, 57 nt, Homo sapiens
cauacucacuguuguaucuucggugucaaacauagcaccugguacacaguaaguaug

SEQ ID NO: 2241920 - RNA, 69 nt, Homo sapiens
gccaauuaacaugucucggagaucucucaaagucgguucaaacaaacccacuuuagucucuuguuuggc

SEQ ID NO: 2241921 - RNA, 69 nt, Homo sapiens
gugauuacgcaggcauagucuugaguuuuauuuucaguuugaauacugcuaacuagucuguacagucac

SEQ ID NO: 2241922 - RNA, 77 nt, Homo sapiens
ugguggugcacaucuguguuccagcuacucaggaggcugaggcaggaggauggcuggagcccagaaguucaaggcca

SEQ ID NO: 2241923 - RNA, 66 nt, Homo sapiens
aauuacagaucaguuauuuuguagacugucccucaauuuaggguugucugauaacugguugugauu

SEQ ID NO: 2241924 - RNA, 97 nt, Homo sapiens
cagugaucucauaaagugcacugagaauaguugccaaaguuuuguuaagagcuuuuugggcagcuauugacuuuauauaauguuuauuagauuacug

SEQ ID NO: 2241925 - RNA, 114 nt, Homo sapiens
aguuugcuaauauuguaucuagaauuuuugaaacuauauucauuggugaaauugcccuauaauuuugcacuuuuguaauaugguuuugggauuuuggcauuaaaguuacaagcu

SEQ ID NO: 2241926 - RNA, 81 nt, Homo sapiens
cucuaguucccugaaguguuacucuagauugucuguuugugcuuuuucagacuuuuugauguaggcauuuagggcuaugag

SEQ ID NO: 2241927 - RNA, 67 nt, Homo sapiens
gcaguguugggauggaaauuuguaccccauccacacagaugggcaucuucccaucccaagacaaugc

SEQ ID NO: 2241928 - RNA, 71 nt, Homo sapiens
cuuuuccaccaucuaagagaaaggaaguucagagccuuagcuucaacaccacaauuucuuaacuggaaaag

SEQ ID NO: 2241929 - RNA, 87 nt, Homo sapiens
uauauaagaggaauaacaugucagaaucaacuugaguuuaucccaggaauacaacacugguucgacaugugaaaaucacucaguaua

SEQ ID NO: 2241930 - RNA, 74 nt, Homo sapiens
ucuggugauugcauguugggagcaaaugaagguaaugguaaauggcuuuuaucuacucucaacuuccucccaga

SEQ ID NO: 2241931 - RNA, 55 nt, Homo sapiens
auggcaaugaacgucuacggcacaaccgcagugcugugacuguugcauuugucgu

SEQ ID NO: 2241932 - RNA, 90 nt, Homo sapiens
cuagguaaggccugggacacauggaguuagaugcuggaauaagucagaccuuaucugcacuucugucuagguccuaggcuccacaccuag

SEQ ID NO: 2241933 - RNA, 69 nt, Homo sapiens
uuucucagaugucuuacccauguugaaaacauuugugugaucacacuggguaacauaucuguuaagaga

SEQ ID NO: 2241934 - RNA, 55 nt, Homo sapiens
auauccaguucaaugaaagaaaugauccuauuguguuuuucauugagugugauau

SEQ ID NO: 2241935 - RNA, 64 nt, Homo sapiens
ugagcacauuuacaucaguucccugugucccccaagucugaugauggugauauggaugugcuca

SEQ ID NO: 2241936 - RNA, 116 nt, Homo sapiens
gaacccgcgugucuuugacuucacauuucaaauguucuuucaccacccaugcagaaagaugagacagggugugugguaggacguuuucuagauuuggaaacagaggacucugguuc

SEQ ID NO: 2241937 - RNA, 68 nt, Homo sapiens
ucaaaucaguggauuuaaccugaaucaucaguaucaccucuggugauuuuauuuaauuaacugauuga

SEQ ID NO: 2241938 - RNA, 60 nt, Homo sapiens
gaaguggaauuggcuggauccuaugggguucuuccauagguugucaucagucuccacuuu

SEQ ID NO: 2241939 - RNA, 79 nt, Homo sapiens
gugccuagcuacaguuguuuuacuucucucugaugauaacuuggagugaauugagagaacuguguuaaaugccuggcac

SEQ ID NO: 2241940 - RNA, 97 nt, Homo sapiens
aggcaggaggaucgcuugagcccaggaggcugaggcuguagugagcugugaucaugccacugcacuucagccugggcaauagggugagacccugucu

SEQ ID NO: 2241941 - RNA, 55 nt, Homo sapiens
cauuuuaauaauagaauaaccuuaggcuuggccuaaggugguggugauugagaug

SEQ ID NO: 2241942 - RNA, 76 nt, Homo sapiens
gugccacacuaagaagaaauaaauauuguaauugaacuaugauucagugcuuuuuguugucaucauuguuuggcau

SEQ ID NO: 2241943 - RNA, 83 nt, Homo sapiens
cccaccaaauuaaaauggcaucuacguuaaaugucaugaguaaaggcaagacaacucaaggcauuuaccugcaggugucuggg

SEQ ID NO: 2241944 - RNA, 74 nt, Homo sapiens
gguguuauggugugguguuugaguagugucuaucagaacaaauacagauuuuacacaucaccgcucguguuacc

SEQ ID NO: 2241945 - RNA, 109 nt, Homo sapiens
cagaucaucaggcauuagauucucauaggcacacaaccuagaacccucgcaugcucaguucacaacaggguuugugcuccuaugagaaucuaaugcugcugcugaucug

SEQ ID NO: 2241946 - RNA, 130 nt, Homo sapiens
ugaacuacagaggcacauuaaccauggucuguucagagccuaaagagaguagggcaaggauggugcugcccaccaccauugcacugaacuuuccaaggcuccggcacaugucaugucacuccuuagucua

SEQ ID NO: 2241947 - RNA, 66 nt, Homo sapiens
agaaagauuuaacucugugagcugaauccacacaucacaaagcaguuucacaggcagcuucuuucu

SEQ ID NO: 2241948 - RNA, 72 nt, Homo sapiens
uagagauugggaggcaauaugagggaggcuucuggggugccggaagugaucuauuucuuuccuugaucucug

SEQ ID NO: 2241949 - RNA, 65 nt, Homo sapiens
agauucagaaaguguuuacgaguuagaaugaccaauagguuaaguagauaguugguucugaaucu

SEQ ID NO: 2241950 - RNA, 78 nt, Homo sapiens
gcccagcuccagaaguccagaagcugacccugaggccaaggcccagcagcaugaggggacuucugcagagccccgggc

SEQ ID NO: 2241951 - RNA, 60 nt, Homo sapiens
uucacacuagccacucugguaguaaucgguuaggguauuagaaagagugcuggaugugaa

SEQ ID NO: 2241952 - RNA, 78 nt, Homo sapiens
guagauauuacaagcagcauuaccaagacauggcaaaaagaguuugucugaauuguaauguugcguuugugaaccuau

SEQ ID NO: 2241953 - RNA, 90 nt, Homo sapiens
augcaggcagaggaaacagaggugccacaauaucaucuguuugcaucuggauucuauauugccuugccuacuuuuccaucucaccugcgu

SEQ ID NO: 2241954 - RNA, 76 nt, Homo sapiens
agaugaaaauuccugggacucuuuaucagagauuaugguauagcauuucuuuguuggaguccaaggauauuuauuu

SEQ ID NO: 2241955 - RNA, 74 nt, Homo sapiens
uugggcuuagcaguuguuguuacuuguauuuugauaguuccaaugcagacaugacaauuaauugaggugcccag

SEQ ID NO: 2241956 - RNA, 67 nt, Homo sapiens
caggguggauuuuauuuuaauuaauuaauuuauuuauuuauuuauuuugagacggagucucacucug

SEQ ID NO: 2241957 - RNA, 66 nt, Homo sapiens
aaaaggcuagcuaguaacagaaauaggaugaagacgugucucuugcucugaguacagcugucuuuu

SEQ ID NO: 2241958 - RNA, 89 nt, Homo sapiens
cucaggguucacugauguuguaguaugagucaaaauuuccuuccuuggcugggcaugguggcucaugcaugcaaucccagcacuuugag

SEQ ID NO: 2241959 - RNA, 57 nt, Homo sapiens
gcuaacaaguuucuugguucuccagcuugcacguggccuauuaugagacuucuuagc

SEQ ID NO: 2241960 - RNA, 70 nt, Homo sapiens
guggauuauuguacuuucaauaagguuagaacaucuuugauuguagguacaauguuuuacccuuguccau

SEQ ID NO: 2241961 - RNA, 85 nt, Homo sapiens
ggggacaugagaaucauuucagcuuguaaugaguggcuacuucaauaauaagcucaauacauuuuuguuguguuguuauuucucc

SEQ ID NO: 2241962 - RNA, 57 nt, Homo sapiens
guccuaccuggaggaacucaggacugcagggacagcugagaagaaacagguaaggac

SEQ ID NO: 2241963 - RNA, 62 nt, Homo sapiens
ggguuggaagggcacaaauggcuugcuuccacucauagccaagccaguguuccuuguggcuc

SEQ ID NO: 2241964 - RNA, 63 nt, Homo sapiens
cagcugcgcagcaguaacaggcaguggcccgccuucacccaguucuuguacucggcgcaguug

SEQ ID NO: 2241965 - RNA, 86 nt, Homo sapiens
gcaauguaguccacauccaucagacggcaggcguugaguaccagagaggcauaccaugucuauaaucugaggacauccugcauugc

SEQ ID NO: 2241966 - RNA, 89 nt, Homo sapiens
ggagucuugcucuguugccuaggcuggagugcaguggcaugaucucggcucacugcaaccuccgccucacaggguucaagagauucucc

SEQ ID NO: 2241967 - RNA, 72 nt, Homo sapiens
aggaaugcuuauacacuguugaugggaguauaaauuaguucaaccauuuuagaagacagugugaagauuccu

SEQ ID NO: 2241968 - RNA, 83 nt, Homo sapiens
guucagcuuaagacuuuuugcauuuuugauuguugaaacauuguauuagucaugaaauguaugagucuggguucuuugugagc

SEQ ID NO: 2241969 - RNA, 87 nt, Homo sapiens
gaggaucacuugaacccuggagguugaggcugcagugagcagugauugugccauugcacuccagccugagugacagagugagacuuc

SEQ ID NO: 2241970 - RNA, 74 nt, Homo sapiens
gcccccacucugcugcaacacacagcgcucugcucagggauggggcaguggagugcuguuguuacacaaggggc

SEQ ID NO: 2241971 - RNA, 108 nt, Homo sapiens
cuuguaaaaauuauucaacauauacagaaauuuaaaaagcagcauugcagguuaugugagauuauguaugucugcucuuuggaacuagguugaaaugauagcuacaag

SEQ ID NO: 2241972 - RNA, 87 nt, Homo sapiens
ggggaaucacuugaaccugggaggcggagguugcagugagccgagaucgcaucacugcacuccagccucgcaacagagcgagacucc

SEQ ID NO: 2241973 - RNA, 66 nt, Homo sapiens
agaggagggguugacuagauuacagauguuaaaccaggggucugugguucaaaccagcaacucucu

SEQ ID NO: 2241974 - RNA, 59 nt, Homo sapiens
ucuuggucaggugcuuguggagguuuagcugaugcccuuuggcuguuucuggacuaaga

SEQ ID NO: 2241975 - RNA, 102 nt, Homo sapiens
agauucacagucucagaaguuggcaucugucauggaaaucuacauuguuagcucaacugucugauagaacuuucuaugauaauugaaauauucugugaaucu

SEQ ID NO: 2241976 - RNA, 68 nt, Homo sapiens
caagauucagcuucaaaaaauggucuuauguacaaagcagccaguaccauuccguuggagcuggcuug

SEQ ID NO: 2241977 - RNA, 88 nt, Homo sapiens
gccaugacugugcuuguauguuuguucuuucagaugaucagaaaaaucacuucuuaaucuaaagaacagagcaaaauuccauuguggu

SEQ ID NO: 2241978 - RNA, 60 nt, Homo sapiens
uggaaucuagagaaaugcaaacauaugaacugaagguggugcucuuuucucuagauucca

SEQ ID NO: 2241979 - RNA, 83 nt, Homo sapiens
ucugucuaguacugucagcaggguguugaagucucccacuauuauugugugggaguguuaagucucuuugaagugcucuaaga

SEQ ID NO: 2241980 - RNA, 62 nt, Homo sapiens
aauguaggguguacauauuuaggauuguuaaguguuguuguuggauuguacacccuaucauu

SEQ ID NO: 2241981 - RNA, 58 nt, Homo sapiens
ggacguagagaaaugugaaauggaguaggcauucacauuccaucacaaaacugcguuu

SEQ ID NO: 2241982 - RNA, 69 nt, Homo sapiens
uuguuuuuaugucuguacaucgggcggcccgcgagcaaggcuggcgucggccugugaguauaaaaguga

SEQ ID NO: 2241983 - RNA, 57 nt, Homo sapiens
uugugcuaauacauacagugcuacaaaaacaaugugaugcauaagugauuagcacaa

SEQ ID NO: 2241984 - RNA, 83 nt, Homo sapiens
ucuuuacaaggggaguucaugcauuuguggauuuguaugaggauaaaguugaaucacauguguaugagcuuugauuauggaga

SEQ ID NO: 2241985 - RNA, 74 nt, Homo sapiens
acaagcgaauaugaauagaaguuuacuccuuuuugucauauaaaagguagcguuuuuguuugauuuuuguuugu

SEQ ID NO: 2241986 - RNA, 60 nt, Homo sapiens
caaaggugcuuuccagguccaagguggcaccaaaacuguuggccuggggaucacacuuug

SEQ ID NO: 2241987 - RNA, 113 nt, Homo sapiens
ucuggguauccagcucuuuacugaucuacauggcacagaguagaugcucaauaauauuuuguuacauauuuguucuguccagagaaggggauuagcaaagugggcacagcaga

SEQ ID NO: 2241988 - RNA, 56 nt, Homo sapiens
cucaggggacugauucaggggauggggugggguucccugaagaagugaccucugag

SEQ ID NO: 2241989 - RNA, 97 nt, Homo sapiens
gugcagaaugugcagguuuguuacauagguauacaugugccauaguaguuugcugcaccuaugaaccuguuaucuagguuuuaagaccugcaugcau

SEQ ID NO: 2241990 - RNA, 95 nt, Homo sapiens
uguguauaauauacugguccagugcaaggacauuuagguuguuuucauugaaacagaacugcaauaaauguccuuugcgucugucuuuguauaca

SEQ ID NO: 2241991 - RNA, 96 nt, Homo sapiens
cauuauguuuuauaaaaauuuucuauuaucuagaaauuucagcagauuggcaguuggaaguauagauaauugaaaguggguacuauaauaguagug

SEQ ID NO: 2241992 - RNA, 84 nt, Homo sapiens
ggguugaaugguaauuauuuuaaguuuuuugaggaauugccacacugcuuuucacaauggcugaacuaauuuacauucccaccc

SEQ ID NO: 2241993 - RNA, 61 nt, Homo sapiens
uucauaguguaccugaaggcacaggauaugaaugcaugaacuacauuuaggacauuaugaa

SEQ ID NO: 2241994 - RNA, 73 nt, Homo sapiens
ccuuauggucagggacucuguuuugagucugcugugucccuagagacuagagcagagcccucucuauaauagg

SEQ ID NO: 2241995 - RNA, 79 nt, Homo sapiens
ggacaggcagcugcuuuugaugacaaaaacaauucugucccaccagauguuuaucccaucaugaagcacacguaggucc

SEQ ID NO: 2241996 - RNA, 55 nt, Homo sapiens
uuuuuggcuaaucaaauagaugaacaaaguucaaaggauuuagauuagcuagaaa

SEQ ID NO: 2241997 - RNA, 85 nt, Homo sapiens
gaacauuacaguugguguacauauauguauguaugucuguuacauucacaguuaggaguauauauaugcugcacuacauauguuc

SEQ ID NO: 2241998 - RNA, 79 nt, Homo sapiens
ggaggccgcuccuauggcggugugggcggugcagcucauucccccggggcucccagccucccacccccauccggccucc

SEQ ID NO: 2241999 - RNA, 61 nt, Homo sapiens
gaaggcauggugacuauuuaggcagcuguuagcagcagucuggacaagguaugaugguuuc

SEQ ID NO: 2242000 - RNA, 64 nt, Homo sapiens
cccagggagcucugucuguccuggaaagugucacaaguuuggggcuagaugagagcuuccuggg

SEQ ID NO: 2242001 - RNA, 78 nt, Homo sapiens
ccagcgauugauagaucauaugguagguauauuuuuaguuuuuugaggaaccuccauauuguuugcaaugguugcugg

SEQ ID NO: 2242002 - RNA, 87 nt, Homo sapiens
ggagaaucgcuugaaccuggaggcagagguugcaguaagcugagaucaugccauugcacuccagccugggugacagagugagacucc

SEQ ID NO: 2242003 - RNA, 63 nt, Homo sapiens
ugagaaugaugauuuccaguuucauccaugucccuacaaaggacaugaacucaucauuucuca

SEQ ID NO: 2242004 - RNA, 66 nt, Homo sapiens
ugacucagauagguguguauucucaagaagcuuucauucuaaugacacauacuuugucuccaguca

SEQ ID NO: 2242005 - RNA, 81 nt, Homo sapiens
gguugcuuaagccuggagguugaggucgcagugaacugugauuacaucacuggacucuagccugggugacaaagugagacc

SEQ ID NO: 2242006 - RNA, 59 nt, Homo sapiens
uaaguccacguguucucaucauuuagcucccacuuauaagugagaacaugugguauuug

SEQ ID NO: 2242007 - RNA, 68 nt, Homo sapiens
gcuguuaguauuacaggguauaaguuucucaggcuacaaagcaugcucauacccaguagcacaacagc

SEQ ID NO: 2242008 - RNA, 86 nt, Homo sapiens
ugcacaucuuaggucggugcaaauguaauugcaguuuuugucauggcaaaaaccgcaauggcauuuccaccaaccuaauauaugua

SEQ ID NO: 2242009 - RNA, 109 nt, Homo sapiens
gcagagagaagaagagagggagagaugcagguuuacacugugcugagggaagcaggagaguacagguauagauguguguucugguuccucuguuggucucaguuucugc

SEQ ID NO: 2242010 - RNA, 79 nt, Homo sapiens
ucuaaguaaaaaucuaguaugauuuuaagugcagaaaaaauaugguaauugcauggucaagcuagauuuuaaugauaga

SEQ ID NO: 2242011 - RNA, 77 nt, Homo sapiens
gaauaccaagugaaugaugugaaguguaaaccaaccauuguuguguuucauguuacugucauacacuuguuuccuuc

SEQ ID NO: 2242012 - RNA, 65 nt, Homo sapiens
uugcaugauauugcagaauguuggugccacuacuaaacugguacuauaguaaauaauacauguaa

SEQ ID NO: 2242013 - RNA, 59 nt, Homo sapiens
uguuauugagguuacuuauaaggugugauagaaacaccaaggaagaacacucaauagca

SEQ ID NO: 2242014 - RNA, 76 nt, Homo sapiens
uacagguacaaugugcacuauuagggugauaguuacacuaaaagcccagacuucaccacugcacaauguaccugug

SEQ ID NO: 2242015 - RNA, 59 nt, Homo sapiens
auucagaacuugcaggauugugggaguagauggccuggcuucucuugugguucuugaau

SEQ ID NO: 2242016 - RNA, 66 nt, Homo sapiens
gugaaauacauaaucccaagugcuggacuuguuauaggaugucaaguguuuggcuuaugguuucau

SEQ ID NO: 2242017 - RNA, 55 nt, Homo sapiens
guuuuuaugccagugucaugcuguuuugguuacacuaugacacugucauaaaaau

SEQ ID NO: 2242018 - RNA, 86 nt, Homo sapiens
gucaacuaaggauuguuauuaucauggcugccuggaugcugcuguuagggcauuuagcauggaggcggccauaguguccaguugac

SEQ ID NO: 2242019 - RNA, 79 nt, Homo sapiens
aggcuggagugcagugguuugaucacagcucacugcagccucgacuucccaggcucaggugauccucccacuucagccu

SEQ ID NO: 2242020 - RNA, 57 nt, Homo sapiens
aaaaucuaaguagcgaguaaggcuaauugaccagcauuuacuccuuaaugagguuuu

SEQ ID NO: 2242021 - RNA, 76 nt, Homo sapiens
ucugaauauucugugguuuaaggaauuuugacuuguagguagaaguuaagauuauccaaauuacuuuuuaugagga

SEQ ID NO: 2242022 - RNA, 71 nt, Homo sapiens
uguggaaucccaagauaauuuguuuguagauggauaccuaguuugcauauucgaguuauuuugggaccaca

SEQ ID NO: 2242023 - RNA, 87 nt, Homo sapiens
uuaguuuuccuuccauaaaauggagacgauaccauuaaaaauuaaaaauuaaaugguacugucucuauuuuguagaagggaaacuga

SEQ ID NO: 2242024 - RNA, 63 nt, Homo sapiens
guguaguuugagguaugggggcaggauuugaaucaguaagaugacugaugccugaaauuacau

SEQ ID NO: 2242025 - RNA, 101 nt, Homo sapiens
ugaggcaugagaauugcuugaaucuggcuggcagagguugcagugagccgagacugcgccauugcacuccagccuggaugacagagugagacucggucuua

SEQ ID NO: 2242026 - RNA, 106 nt, Homo sapiens
agaauugugcugugguuguuauagaucaauuaauuguuacuugggauuugauauucugccuuuccaguacagaauacuugauaauaaaagcauaguacauuauucu

SEQ ID NO: 2242027 - RNA, 99 nt, Homo sapiens
gaguuucauacauguuguugugcauaucagagguuugcugacuuuuauuacuguguaguguuccuuuguguggacaccucacaauuuguuuauguauuc

SEQ ID NO: 2242028 - RNA, 56 nt, Homo sapiens
ggaggacaugaccaaaacagagauaagcaaauccauguucuugcucguguaucuuc

SEQ ID NO: 2242029 - RNA, 78 nt, Homo sapiens
ucuuucaucuuugcugauugucaucaauauuauuaccaaucuugguaguacuuuaggugagaguaaugagauugaaga

SEQ ID NO: 2242030 - RNA, 74 nt, Homo sapiens
ggguagugggaacugaggugaaaagacauggacaaauugaagagugcuuuugaaaucaguuucucacuugauuc

SEQ ID NO: 2242031 - RNA, 55 nt, Homo sapiens
auaucaaggccauuuucuaaauucgggcuugaaauacuagaaguggcuuugauau

SEQ ID NO: 2242032 - RNA, 63 nt, Homo sapiens
uaugagaugaggccacuggguauuuuugaaaacagucaguauauaaugggcucucagcucaua

SEQ ID NO: 2242033 - RNA, 67 nt, Homo sapiens
aaugccuucuuaagaguaacagaagaccuuuagcaaauuguuccuuugcuguuguacuccaggcauu

SEQ ID NO: 2242034 - RNA, 96 nt, Homo sapiens
ggagugagggaaagagaggagcucagggugacuccuggguuuggggcuuggccgaugcucucccugagcagccugaguuucccucugauucauuuc

SEQ ID NO: 2242035 - RNA, 94 nt, Homo sapiens
agaagaaucgcuugaaccccugagguggagguugcagugagccaagauugcgccauuguacuccagccugggcugcaagagugagacuccuucu

SEQ ID NO: 2242036 - RNA, 76 nt, Homo sapiens
uccccaccaguagaaucaguggauucugacuucucuccuagauuccagaaggagccugauuuccuagugaaggggg

SEQ ID NO: 2242037 - RNA, 91 nt, Homo sapiens
uuguggauauugaaguuugaagccuguuguucaucuauagaugcacuggaugggauuggaagucuucagauuucaguaggguuuuccacaa

SEQ ID NO: 2242038 - RNA, 65 nt, Homo sapiens
auggugaaacacagaaagcuuucucucugaaauugaaaaggaggcaagaaugcuuguuucaccau

SEQ ID NO: 2242039 - RNA, 55 nt, Homo sapiens
gugauaucuuacaauucucuuuuaggacagaguccagacaggagagaagagucac

SEQ ID NO: 2242040 - RNA, 74 nt, Homo sapiens
gucuaguuuuaauacauuaagacagcuuuuccuuacuggccaggacauaugaugauuaaugguuggaacuggac

SEQ ID NO: 2242041 - RNA, 72 nt, Homo sapiens
uccacuucuugucacugcauccccagcuccugguacaucgugggaguggggcggacaggaccaggaaguggg

SEQ ID NO: 2242042 - RNA, 69 nt, Homo sapiens
cagggcuacagauagcacuaagggaucugcgcauggcugugcagcucauucauggcauuucugguccug

SEQ ID NO: 2242043 - RNA, 100 nt, Homo sapiens
guccgcccccugcagccucacugaacacaccugcagcacguguguccgcaucaugauguccacagggguguucaggagguugugucagguucugcuggac

SEQ ID NO: 2242044 - RNA, 80 nt, Homo sapiens
ggcugcggagccuagcagacucaggccugugggaaugggauuuguuacaaaucuagguuuguuacuggcuucagaaagcu

SEQ ID NO: 2242045 - RNA, 72 nt, Homo sapiens
augugguacauaugcacaguggaguacuauucugccggaaaaagaaugagauccucucacuugcaacaacau

SEQ ID NO: 2242046 - RNA, 79 nt, Homo sapiens
cugugcaaaaauaaguugcuguuggucaaaccauccgauuuaugguauuugauuauagcaugcuuaggaacuaacacag

SEQ ID NO: 2242047 - RNA, 58 nt, Homo sapiens
accaaugucuuugacugaugaacccacaaacaggcauucaucagucaaagacaauggu

SEQ ID NO: 2242048 - RNA, 72 nt, Homo sapiens
guguucugaauguuuucuucuauucugauguuacacucucuaaaauuaucagaaaccugcauuucagagcac

SEQ ID NO: 2242049 - RNA, 62 nt, Homo sapiens
uauugcagugagauccaucuggugaaguaagaaaacauuuggugaaaaugucaccugcaaua

SEQ ID NO: 2242050 - RNA, 84 nt, Homo sapiens
gugguggcauucagaacugaacaaaccagucugugaaggucaggguccuauuaggcagggucugaucaguacuggggccaccac

SEQ ID NO: 2242051 - RNA, 78 nt, Homo sapiens
gcuuuggcauagaggcucucaagcuuugcugcacauccaaaucaccugcagagcuuuugaaaaucucaauguccaggc

SEQ ID NO: 2242052 - RNA, 59 nt, Homo sapiens
gagaguagugucauuugucacuaagcaaauacuucuugacagugcuugaaauugcucuu

SEQ ID NO: 2242053 - RNA, 69 nt, Homo sapiens
cuucacagucugggcuuguuuguaccuguccacaagaaaggcaaguacaaacaaacccagacugugaag

SEQ ID NO: 2242054 - RNA, 67 nt, Homo sapiens
uggggguaaggagauuucuuugugauucccaaaaacauaugagcugauuuccuuaccauauugccca

SEQ ID NO: 2242055 - RNA, 74 nt, Homo sapiens
uagccacugguccucuuggauuguuucucuugguaugaaacuuuucauccuaaaagcaauuuggauucgggcug

SEQ ID NO: 2242056 - RNA, 55 nt, Homo sapiens
ccuuguaccccugagucccauaauuguuacaguuugccacuccugggugucaagg

SEQ ID NO: 2242057 - RNA, 86 nt, Homo sapiens
aggucuuuucugagcauauguguagccaugggaaugaauguugccuucuaauuucuuugguaugugcaugugcuuuucaauuaccu

SEQ ID NO: 2242058 - RNA, 66 nt, Homo sapiens
ggugugcaacuuucauuaauauuugguaaugccuuuucuuauaucccagguauugaaguugacacc

SEQ ID NO: 2242059 - RNA, 64 nt, Homo sapiens
gcugauauuuuaaaauuggcugguaauuauguuuuuaauauccggcauuaugaaauaucucagc

SEQ ID NO: 2242060 - RNA, 83 nt, Homo sapiens
gguuaucaucuuuugguugugagagacugggggcaaaauacucuguuuugaccccuucuaauagccucauuguaaugguagcu

SEQ ID NO: 2242061 - RNA, 102 nt, Homo sapiens
gaggcaccaguuuugcaugagaaggaugcuaguguuuuaaugggaucaaaaugacugagcggucccugaaaauuagcauuuuaacuccucucucugggccuc

SEQ ID NO: 2242062 - RNA, 69 nt, Homo sapiens
gacugggcuuagcagggucugaccucacuuggagucugguguggucagauggcagcugggccuggaguc

SEQ ID NO: 2242063 - RNA, 91 nt, Homo sapiens
uuaauuucaaaauagcauguuuagcaggguuuuuugcgguuguucugaagauccacuguacucuguauaaacauugcuguauaggaauuaa

SEQ ID NO: 2242064 - RNA, 61 nt, Homo sapiens
cuauauguccauguguucucaucauuuagcuccuauuuaagugagaacaugugguauuugg

SEQ ID NO: 2242065 - RNA, 61 nt, Homo sapiens
cagaacucuuaucaaaacaggucaauaugguguguaugaucuguguaacauaggaguccug

SEQ ID NO: 2242066 - RNA, 70 nt, Homo sapiens
gcuugauacuuauggcugugaaaugguaggugguuaauucagccacaucauggauacaguuauguuaagc

SEQ ID NO: 2242067 - RNA, 61 nt, Homo sapiens
guggcaugaaagcagauaccaccuugccuuuuuugcaaguugaguucuuccuaucauccac

SEQ ID NO: 2242068 - RNA, 62 nt, Homo sapiens
aucuguucugugaaaugugucauuuugugaacacgauagagcacacuuacacgaaccuagau

SEQ ID NO: 2242069 - RNA, 70 nt, Homo sapiens
aagucuuugcuauugugaacagugccacaaugaacacaugugugcauaugucuuuauaguagaaugauuu

SEQ ID NO: 2242070 - RNA, 66 nt, Homo sapiens
guauuucuaguucuagaucccugaggaauugccacacugacuuccacagugguugaacuaguuuac

SEQ ID NO: 2242071 - RNA, 59 nt, Homo sapiens
gggaaggagcacaggacuuugauuaucauaagaugugaaaauacuacugucuucuuccc

SEQ ID NO: 2242072 - RNA, 76 nt, Homo sapiens
gcaaagacagcaggcccgugagacuggaagcaagauggagucagccaugcuaaacuucucucacugucaucuuugc

SEQ ID NO: 2242073 - RNA, 106 nt, Homo sapiens
ucuguuagacagcugguagaguacauuuucuuaaauauuugcaggacauagccauguguuaguuguucauguuaagaguagccugugccacuguuuccuagacaga

SEQ ID NO: 2242074 - RNA, 95 nt, Homo sapiens
guuaaggcagggguuuaagugucagaguugcuaaugacacauuuuuuaguagauguugaucauugguuuuuucacauuuucauucaggcuuugac

SEQ ID NO: 2242075 - RNA, 83 nt, Homo sapiens
aggacuuacaaggaauaaggaggguggcagauggagaagggcauuguaccuaccuauugcccugcuuuguucuaaacaguucu

SEQ ID NO: 2242076 - RNA, 65 nt, Homo sapiens
ucccagcaugacagagauaugugaauuuucaaacagaaaauucaaaaguuucuguguuuugagga

SEQ ID NO: 2242077 - RNA, 78 nt, Homo sapiens
uucaguuuccauguaguugaacgguuuugagugaguuucuuaauccugaguucuaguuugauugcaugguggucugag

SEQ ID NO: 2242078 - RNA, 60 nt, Homo sapiens
gucucuucuguagagcaaaaaguaguuagagugacuaguuaggucucucacagagaagac

SEQ ID NO: 2242079 - RNA, 130 nt, Homo sapiens
aggugaaauaaacagccauguugcucacacaaagucuguuugguggucucuucacauggaugcgcaugaaauuuugugaagagaccaccaaacaggcuuuguuggagcaacauggcuguuuauuucaccu

SEQ ID NO: 2242080 - RNA, 119 nt, Homo sapiens
ucugucugcuguguuaacucagcaaggguugugguaggaaagugcaaauguagagguccuauuacuauaugaacauguccuacugaacaaugccaggcgacagaguuacauagugaaga

SEQ ID NO: 2242081 - RNA, 59 nt, Homo sapiens
aggguguggcucugggggagggacccucucacgcacccuucaccauggcuccacacucu

SEQ ID NO: 2242082 - RNA, 56 nt, Homo sapiens
cugcuggugaugucugggcaugugucugcuucacaguccaguguuaugaucaguag

SEQ ID NO: 2242083 - RNA, 86 nt, Homo sapiens
uauuggaaggaaaagugggagucuuccuugcacaggaauguugucuuccauauuuagugcauguugaguucccgaccgccccaaua

SEQ ID NO: 2242084 - RNA, 59 nt, Homo sapiens
uuacuuugcuucaggaagaggaaguaacaaggcauucuuccaucccugagcugaagugg

SEQ ID NO: 2242085 - RNA, 63 nt, Homo sapiens
gaguuuagagugggaucuggaguacuggaugacuuuucucaguguucccauucuaccuugcuu

SEQ ID NO: 2242086 - RNA, 61 nt, Homo sapiens
ugcaccaaaaagccugcuuccauuuccaacaucuuaucuuugugaagcagguuuuucugca

SEQ ID NO: 2242087 - RNA, 60 nt, Homo sapiens
aggaauagcauugaaucuaccaauugcuuugggcaguauggccauuuuaaugcuauuucu

SEQ ID NO: 2242088 - RNA, 99 nt, Homo sapiens
cuaugcugugcuggacuucugaucuacagaacugugaacuaaaaaagucgauguuguuuuaaagcacggaguuuguggcaguuuuuuacauagcaauag

SEQ ID NO: 2242089 - RNA, 60 nt, Homo sapiens
gccaaagagguuuaguuuguugagguuuuguaaaaccuggcacuuagcaaaucugauggc

SEQ ID NO: 2242090 - RNA, 84 nt, Homo sapiens
ggccuccaacuauuuucaguacuucaaaaucuuuaaaggagaacaacgaauuuucuuaagagguaucugaaggcugaagaggcc

SEQ ID NO: 2242091 - RNA, 85 nt, Homo sapiens
uuagagccagagaaugcagggcuucggacaacaaagaccucuggggacagggcagaugucccugagccuggauuccugccucuga

SEQ ID NO: 2242092 - RNA, 87 nt, Homo sapiens
gcgacugggauccuaaguguaugaaacaguccauggcauacccauggguguccuguggugccucuauacauuggcuuuccuaguugc

SEQ ID NO: 2242093 - RNA, 78 nt, Homo sapiens
caaagaaacuaugaacaagugcaaccagguugagccuuuaaguguagccucauucuacauguuaauggauaaccuuug

SEQ ID NO: 2242094 - RNA, 105 nt, Homo sapiens
ccaugaaucacaaauguucuuaauggcaucuagaguggugaauccuuuccaaaacguuuucaauuuacuuugcucagauccaucagaggaaaucacacuuuaugg

SEQ ID NO: 2242095 - RNA, 76 nt, Homo sapiens
uugcuugaacaugggagguggagguugcagugagcugagaucaugccacuguccuccugccuaggugacagagcaa

SEQ ID NO: 2242096 - RNA, 102 nt, Homo sapiens
augaggaaacaccagcuagaggggauguaggaagguuuuucucaauccuagaaaggguuacaaaaugaagacauuugcugcacguccuuugagugguuucau

SEQ ID NO: 2242097 - RNA, 67 nt, Homo sapiens
uaguuuaauggaaauagcauugaaucuauaaauuacuuuggguggaauggccuuuuucauuauacug

SEQ ID NO: 2242098 - RNA, 91 nt, Homo sapiens
caugaugcacggucucuguauugccacaucucagaggcagagaccauuucuguuggaggagaugcugggagagcauagacccuucaucaug

SEQ ID NO: 2242099 - RNA, 92 nt, Homo sapiens
guuuccuagcuagcaauuucuuggggcaauggaauaggugauugaaagaaugucuaacauucacaugcugcaaaaaugguuaacggggaaau

SEQ ID NO: 2242100 - RNA, 79 nt, Homo sapiens
ccucagcugcgugaaaguucuaaaaaauguuaaguuuaugaaucacgugaagcaucauuuggaauuugagaagcagagg

SEQ ID NO: 2242101 - RNA, 65 nt, Homo sapiens
cccugggaauuugaagaccuucugugggacuauuccugcugcuuuaaggcuuucgaguuccaggg

SEQ ID NO: 2242102 - RNA, 129 nt, Homo sapiens
gccaugguuaauucagggacuaugguggucuugucugugggcagcaucuaugguccacaggaagcugaaaagguaagccaagaugcugcccacagacaagaccaccauagucccugaauuaaccauggc

SEQ ID NO: 2242103 - RNA, 66 nt, Homo sapiens
ugaacagagaaacacuggccaugaccacuugugcacugugggcaugaguuuuauguuuuuguauca

SEQ ID NO: 2242104 - RNA, 107 nt, Homo sapiens
gcugggggcuccugggcugugcauggagaaggggacugauucagagacaccaacaacucacaccuggacgugcucccaucuccaccugugcgcccaccucccucagc

SEQ ID NO: 2242105 - RNA, 56 nt, Homo sapiens
uuggucugcucugauguuuucuaucugacagagagaaggcugagcagacaggccaa

SEQ ID NO: 2242106 - RNA, 59 nt, Homo sapiens
uagaccauucuauuuccuaugcgguggugauauucaaggcaggggauagaaauggucug

SEQ ID NO: 2242107 - RNA, 61 nt, Homo sapiens
ggcaauucugggucaaagauuaugugcucuuaaauguuuuauagguuuucacagaauugcc

SEQ ID NO: 2242108 - RNA, 68 nt, Homo sapiens
uauuuaggcaauauauucaugucucuccuaagagaggugguuucaaagauaugagguauuccugaaua

SEQ ID NO: 2242109 - RNA, 88 nt, Homo sapiens
acaaggacuaaggaagcuagcaggaauuggugacccuuauaacaggagaauaagaaagacucuuucucuguggccuucuuaaccuugu

SEQ ID NO: 2242110 - RNA, 70 nt, Homo sapiens
ggaacccuuguacacuguuggugggaauguaaauuaguacagccauuauggaaaacaguguggagguucc

SEQ ID NO: 2242111 - RNA, 88 nt, Homo sapiens
ggaggaucgcuugagccugggaggcagagguugccaugagcagagauugcgccauugcacucuagccugggcaacacagcgagacucc

SEQ ID NO: 2242112 - RNA, 57 nt, Homo sapiens
aggccaccagguuaccggggguuuccagucugacccuaucccagugacuuauggccu

SEQ ID NO: 2242113 - RNA, 102 nt, Homo sapiens
cucacaaaaguaacagcuaggggaugauaggagaugcgugcaguuguugcaguccuguauggucccuguuccaugcuccuggcucuaguugaaggccgugag

SEQ ID NO: 2242114 - RNA, 61 nt, Homo sapiens
ugagacucuuagauuggaaaucugaauuuauuuacacgauugagauugaucuagaguuuua

SEQ ID NO: 2242115 - RNA, 129 nt, Homo sapiens
uugaauagguuaugugagaggugacuggguuauuugggaggugacugguuuaucuggcagugacuggguuaucuggggugaauagguuaugugagaggugacuggguuauuugggaggugacugguuua

SEQ ID NO: 2242116 - RNA, 72 nt, Homo sapiens
guugaauggaacucagucugucuguuuccucaucugcaaaaugggaacagcacacccgcugcuuccaucaau

SEQ ID NO: 2242117 - RNA, 83 nt, Homo sapiens
ccacugcaccagaacuuucuacauuaccucuuuugcuucauuccacagcaauggaccuguaggaaguuucucaacaccagugg

SEQ ID NO: 2242118 - RNA, 63 nt, Homo sapiens
uauauggcucuuauuauuuugagguauguuccuucaauaccuaguuuauugagaguuaauaua

SEQ ID NO: 2242119 - RNA, 78 nt, Homo sapiens
gaacuaggguagcggauguugugauucucaguccaaggccaaaggccugagaacucaugggucugcugguguaaguuc

SEQ ID NO: 2242120 - RNA, 88 nt, Homo sapiens
uaucacacucaucccacuagcuuguccuccacccacacugcaucccugagcugggacacgcagaggacaggugugaugaaggugcaug

SEQ ID NO: 2242121 - RNA, 73 nt, Homo sapiens
auuuaucuucauagcaguuagcaggcaagugucacugacgcuauggcuguaugacgugcaugaaagacugaau

SEQ ID NO: 2242122 - RNA, 97 nt, Homo sapiens
gggagauaucagugauucagguauugcuauuucugacuuaagagauaaaaugauaguaacacauugaacgaucgcuagauacgaaaugaccccuccc

SEQ ID NO: 2242123 - RNA, 58 nt, Homo sapiens
ccaucacaugcuuauuuuccucauuggaaauucagaugaggacagaaagguguggugg

SEQ ID NO: 2242124 - RNA, 63 nt, Homo sapiens
ccuucauagucacauucgaugucuccuacaaggccacccugggagacaggaugcuuaugaggg

SEQ ID NO: 2242125 - RNA, 61 nt, Homo sapiens
uacuaccacaaaaugcauacaugcgucuucauggugcuguguacaaauuucugugguggug

SEQ ID NO: 2242126 - RNA, 119 nt, Homo sapiens
guagguacugauauaauuuuuuuaauguacuaaauguuuaacauuugaguuacaguuuuggacagaugguuacauuuuuaaaaagaaggaaaaguuuauaacauauucaguugcucuac

SEQ ID NO: 2242127 - RNA, 70 nt, Homo sapiens
gguauuucuaguucuagauccuugaggaaucgccacaccgucuuccacaaugguugaacuaguuuauacu

SEQ ID NO: 2242128 - RNA, 72 nt, Homo sapiens
cagcuagcuuugcagcaaagagggaggggcauggucugaaagcugugguuccuauuucugcaaggacagcug

SEQ ID NO: 2242129 - RNA, 60 nt, Homo sapiens
gugacuacaggccacaguuugguaagauacuccaaauuccggcugggccugguggcucac

SEQ ID NO: 2242130 - RNA, 66 nt, Homo sapiens
aaaggcaguguggguagagggcaagaaagucugaucgucuugucuguaaucccaauacuacccuuu

SEQ ID NO: 2242131 - RNA, 58 nt, Homo sapiens
uccagcucacagagcaaauuuagccugcuugccugauuuguuggccugugagcuagga

SEQ ID NO: 2242132 - RNA, 84 nt, Homo sapiens
uauugguucuguuuuccuggagaaucuuaacaaaaacagccacuuuggguuuaguuagcaucuccagggcagcagcacacaaug

SEQ ID NO: 2242133 - RNA, 110 nt, Homo sapiens
uaaauuucaguuuucuccuagagugucuuugcgguucacauuuugcuaaguuaaggauuuagcacugugauugacaaaaaauauuacuuacagaaaauaacugacauuug

SEQ ID NO: 2242134 - RNA, 92 nt, Homo sapiens
cuauuuuguuuccuacugugucuucagugccuaggacagugcuuggaauguaugaggcauucaacuaauuauugaagaugcacacagaauag

SEQ ID NO: 2242135 - RNA, 68 nt, Homo sapiens
uucuuuaauucauauaagacauagugaguguuuaaacuaacacaguguuacugguaugaagugaagag

SEQ ID NO: 2242136 - RNA, 76 nt, Homo sapiens
uauuguucagggaaauguuggugucaugaguucucauauaacagcagccagaucaucaguauuugcuuggacagua

SEQ ID NO: 2242137 - RNA, 59 nt, Homo sapiens
cucugucuuagcaucuuugcucagggaacucauccugagacaucucuccugagacaggg

SEQ ID NO: 2242138 - RNA, 57 nt, Homo sapiens
uucagggacuuuagacaagagaggacacaggauugcuucucccucuggggcccuggg

SEQ ID NO: 2242139 - RNA, 58 nt, Homo sapiens
guaaacugaucugaaggccaggcucuccugggaugcuugcaaaucagaucaaguuuac

SEQ ID NO: 2242140 - RNA, 95 nt, Homo sapiens
gcaugggucauggugcacgaucuacauuuaacucuggcuacucagggcagucaugggagagaugugaucggggagugaugcaaucugauuuaugc

SEQ ID NO: 2242141 - RNA, 75 nt, Homo sapiens
cauuguagccaaugaauauauuucauaugauuuugauccuuuuaaauucauugagacuuguuuuguggcccagug

SEQ ID NO: 2242142 - RNA, 111 nt, Homo sapiens
gaacuuucccacagaacauaaauaaaaugcacgcuacccagcuagauuuugguguuagaaaucugugcugcaggagucugcauggcuuuuugaaaugaucugagaaaguuc

SEQ ID NO: 2242143 - RNA, 56 nt, Homo sapiens
aggccaaauagcagguuugcuaaauguuuuaauguuguaaacugcuuccuuggccu

SEQ ID NO: 2242144 - RNA, 67 nt, Homo sapiens
uuaccugaguauuugaggccgaaggaaaugucuucacggaaauuuucuuggcaccagaaucaggcga

SEQ ID NO: 2242145 - RNA, 73 nt, Homo sapiens
gaaagaucucaguggauacugugauguguucuccaaaaagcauuucaaugagcaccauugagcaacaucuuuc

SEQ ID NO: 2242146 - RNA, 61 nt, Homo sapiens
ccuugugcaugaccccagguggggcgggcagaagaaccucccagcugacagaaugauaagg

SEQ ID NO: 2242147 - RNA, 76 nt, Homo sapiens
acaauugcuuuuauuuagggccagguaccacuacauugaccuguguuaauacuggcccuagagagaagucuauugu

SEQ ID NO: 2242148 - RNA, 78 nt, Homo sapiens
ucaccuucuccuuggggggcuucuggugggcgaggagcuuguaaauguuccaguuguucucgaagcuccuggaaggga

SEQ ID NO: 2242149 - RNA, 74 nt, Homo sapiens
gauagcuaugguaguuguugcagguaggauguaacuuccuagguuuacuaccgcucacaauuauauuugcuauu

SEQ ID NO: 2242150 - RNA, 56 nt, Homo sapiens
uggcaagagcaaaauguacaguuagauauuaaauuauuguaugaaaacucuugcua

SEQ ID NO: 2242151 - RNA, 72 nt, Homo sapiens
uagaaucuacuagaggaauugcuauaacuuccuugaaauuggcaaguagcaguuccauuugaugugauucua

SEQ ID NO: 2242152 - RNA, 82 nt, Homo sapiens
aguuuuagggcacaugugcacaacgugcagguuuguuacauauguaugcauaugccauguuggugugcuguacccauuaacu

SEQ ID NO: 2242153 - RNA, 63 nt, Homo sapiens
uccuacuguaaaguaaagcacaucaaggugaaguauuauauuguugcuuuacauuaucuggga

SEQ ID NO: 2242154 - RNA, 85 nt, Homo sapiens
ggucuuacaagucauagauagauucaaagguuuccugauuugcaauugguuaaggagaugaagcuuuaucuaaaaauuugugauc

SEQ ID NO: 2242155 - RNA, 83 nt, Homo sapiens
cuucaggcuucucaguuuucaagcugucgauuccuaacuuggaaaaagggaugcgggagcugaaagcugagaaccuauagaag

SEQ ID NO: 2242156 - RNA, 66 nt, Homo sapiens
gucuagaauaacugcuaucuuucuggccuaaggaacuggguggaagguaaugcagcuuacugagau

SEQ ID NO: 2242157 - RNA, 106 nt, Homo sapiens
uuacuccaucuuggguuuuucuuuacuagcagcaugagaauggaccaauacaguaaauugguaaugguaaagugaggugcugcuguaaggauaccagaaaauguag

SEQ ID NO: 2242158 - RNA, 80 nt, Homo sapiens
gagcagucuugauuuaaucuugguuacauuuuccuagaaagaucauuugucuuagaaaucuguguagccuccaguugcuc

SEQ ID NO: 2242159 - RNA, 81 nt, Homo sapiens
uuuccacucagugaagugugaccucagcaucuccccaccuugguggaaggauggaggcuuaugcuuaggacuggguggaaa

SEQ ID NO: 2242160 - RNA, 73 nt, Homo sapiens
ccaucugcuuggcagaaaaggucggggguuugcaaagggaguagccucugguccuuuuuucccuuaggcgugg

SEQ ID NO: 2242161 - RNA, 78 nt, Homo sapiens
uguaauuuauuagcacauuuccagcacauggcaaucaaucaaugaaaguuuguuguuguuaauguuguuaguaucaca

SEQ ID NO: 2242162 - RNA, 59 nt, Homo sapiens
augaaggcuuucacagcuuuaagggauuauuuaacauugacagcuguugaggcauuuau

SEQ ID NO: 2242163 - RNA, 55 nt, Homo sapiens
ggaucacauggccuagccuaaccuggcugccuaguaaguuagagucaucugaucu

SEQ ID NO: 2242164 - RNA, 59 nt, Homo sapiens
auuuuggaauuuauacaguaaugguugguaaauaucaccuauugccuaaauaccagaau

SEQ ID NO: 2242165 - RNA, 61 nt, Homo sapiens
guugaucuguuguuuggaaguaucaaccaacacagguuggugcuucaucacggaggucaac

SEQ ID NO: 2242166 - RNA, 67 nt, Homo sapiens
ugaacuuuaguuuugaagguuguuaguguccauguguaggaaauuggcaauggcaaagcagaguuca

SEQ ID NO: 2242167 - RNA, 63 nt, Homo sapiens
aggaguuaucauguaguaagacacauuuagaaauuacuaaauguguggacugaugagagucuu

SEQ ID NO: 2242168 - RNA, 108 nt, Homo sapiens
gacuuucucaggggucuuuuccuccagugguagaagaaccugccccucccgcaaaaggggugguuuuaucucuucccuuccccaggaaagguuuucugucucaagguc

SEQ ID NO: 2242169 - RNA, 64 nt, Homo sapiens
agucuugaaugaaauccaaauuuuagguugcuuccaguaaaaugaaauuuuuuauucguuggcu

SEQ ID NO: 2242170 - RNA, 63 nt, Homo sapiens
ggcuggacaaaucuggaaagaaccccucuucacugggguugcucaccuguuaguccauaagcc

SEQ ID NO: 2242171 - RNA, 64 nt, Homo sapiens
guaaucucagcuacuugggagccugaggcaggagaauugcuugaacccgggagguggagguuac

SEQ ID NO: 2242172 - RNA, 90 nt, Homo sapiens
aaaucaggaaauacaggguuaguauugguaauuguaauggcaaaauauuuauuuacaagcacaaauuuaauccugucacuuuccugauuu

SEQ ID NO: 2242173 - RNA, 55 nt, Homo sapiens
uugagauggaaucucgcuuugucacccaggcuggaguacaguggcgccaucucaa

SEQ ID NO: 2242174 - RNA, 79 nt, Homo sapiens
acuugguaccuuuuaaugacuaauuaauauaguggacucauuaaauagguggacauuaauaggguacuuaauguggagu

SEQ ID NO: 2242175 - RNA, 87 nt, Homo sapiens
aucugugguggacagccugggaucuggucacaguccugguugggcuaacuccugacaguuuccagggcugucucuagcaucacagau

SEQ ID NO: 2242176 - RNA, 87 nt, Homo sapiens
ggagucuugcucuguugcccaggcuggagugcaguggcacgaucauggcucacugcgaccuccaccucccgguucaagcaauucucc

SEQ ID NO: 2242177 - RNA, 64 nt, Homo sapiens
gugacauguaaggcucucucuguuaugucuagguggacacagcaaugcagugccuugcagucau

SEQ ID NO: 2242178 - RNA, 56 nt, Homo sapiens
uugagauggagucuugcucuuguugcccaggcuggagugcaauggcacuaucucgg

SEQ ID NO: 2242179 - RNA, 108 nt, Homo sapiens
gaucagccgcagcauuagauucucauaggagcacaaacccuacugugaacugugcaugcaaggcauuuagguuaugugcuccuuaugagaaucuaaugccugaugauc

SEQ ID NO: 2242180 - RNA, 89 nt, Homo sapiens
gcagagaauucaugacuaaguccucaaaagcaauugcaacacaaacaaaaauuggcaagugggaccuaguuaaacuaaagaguuucugc

SEQ ID NO: 2242181 - RNA, 67 nt, Homo sapiens
gaucauaaauguuuuauauaaguagcaggcacauuggagucauauugcauaugcagcauuuaugauu

SEQ ID NO: 2242182 - RNA, 88 nt, Homo sapiens
agacuguaggcuccuuaagagcaagaacucuggcaaguuucuuuucugacuagcaaauugaucuugcuuuugcagagcuucucagucu

SEQ ID NO: 2242183 - RNA, 55 nt, Homo sapiens
ugaguauuuaccaugugccaggaacuguuucaagcaucuugcacaugugaacuca

SEQ ID NO: 2242184 - RNA, 69 nt, Homo sapiens
uggucagaaugugcuucuggcuguggucauagacgggugugagucagccccaggagacauacuuugcca

SEQ ID NO: 2242185 - RNA, 59 nt, Homo sapiens
ugagacggaguuuugcucuugucuccuaggcuggagugcaauggcacaaucuccucuca

SEQ ID NO: 2242186 - RNA, 66 nt, Homo sapiens
gcugcuaugaaagauaaucaaagcuaaagcugauugccaguuacacauuuagaucuuuuaugcagc

SEQ ID NO: 2242187 - RNA, 108 nt, Homo sapiens
aauuggauuuagaagucuauggaaauuauuaggaagauggguuuuaagugaccaguuuuuuauacaucuucuuugacagugauuugugcauaagcuucugaaguaguu

SEQ ID NO: 2242188 - RNA, 83 nt, Homo sapiens
auaaguaugggggaacugugaauauuccaacuuuggccacaacauuggguagauaucauaguugcccaguaaugaaaacuugu

SEQ ID NO: 2242189 - RNA, 82 nt, Homo sapiens
cugugacuuugggcguuucuuaaccucucugcagcuuauuuauuaagaaugcugugaagaugagaugacgcccuucauacag

SEQ ID NO: 2242190 - RNA, 55 nt, Homo sapiens
uuggugugucuccuguugcacuaucuuccuaagaaccugcagcaucaguacccag

SEQ ID NO: 2242191 - RNA, 82 nt, Homo sapiens
cuuacucaacuuuauggcauucuguauaacauugcuccugaccaaggagcuuguuuuauagaaagucaaguguaccagugag

SEQ ID NO: 2242192 - RNA, 74 nt, Homo sapiens
uaaacgugcagagaucaauagcauuuugucuguuaaggaucagaauuugcuucuguuuguuucugucauguuua

SEQ ID NO: 2242193 - RNA, 71 nt, Homo sapiens
uauugcuacuuugccuuccaaagucuugccuucuacagcuacauaacuccaggaaaucagaagugguaaug

SEQ ID NO: 2242194 - RNA, 111 nt, Homo sapiens
cuguuguuuauuaucacuggacuugguuauaauaugugagaucucagaauugaacuaaucauauuaauuuaaacauucagagauuuuaggucuaguacauaagaaauauag

SEQ ID NO: 2242195 - RNA, 57 nt, Homo sapiens
ucuaguucuagauccuugaggauucaccacacugucuuccacaaugguugaacuaga

SEQ ID NO: 2242196 - RNA, 60 nt, Homo sapiens
agagguguugugaauuauauuuccuuuuccuggccuaguuguacaguacacaacaccuuu

SEQ ID NO: 2242197 - RNA, 127 nt, Homo sapiens
gaguugauuuuuguauaugaugagagagauaagucuauuuucacguaucugcauaugaauauucaauuuuccuagcacuauuuauugaaaaggauguccuuucuccaauguauguucuuaucagcuu

SEQ ID NO: 2242198 - RNA, 59 nt, Homo sapiens
cucaccucaggugaucuggcuaccucugccucccaaagugcuaggauuaccugggggag

SEQ ID NO: 2242199 - RNA, 56 nt, Homo sapiens
uggauacguucacucucuugauugcggugaugguuucaaggaguauacguaugcca

SEQ ID NO: 2242200 - RNA, 74 nt, Homo sapiens
guguuuaagacuuagcuagguuuccauuuagaucuucauaucuguugcauggaagaaaguuggguucuuggcau

SEQ ID NO: 2242201 - RNA, 130 nt, Homo sapiens
guauugcuuuagcuauuuauggucuucuguuguucuauacaaaauuuaggauuuuuuccauuucuguggagaauguaauugguauuuugauagagauuacauggaaucuguagauugcuuuggguaguac

SEQ ID NO: 2242202 - RNA, 76 nt, Homo sapiens
ugccuccauagcaggaagaaagcuacucaggagacagcucuuaucacugagacacucuuaucugcauaacaaggca

SEQ ID NO: 2242203 - RNA, 55 nt, Homo sapiens
ucccauaggcuuuuucacccagaauccucaucuuuugagguaaaauccuauggga

SEQ ID NO: 2242204 - RNA, 64 nt, Homo sapiens
uagggaguguuguuuagguugugccaugacacacacacucaugcagagcaaagccgcaccccua

SEQ ID NO: 2242205 - RNA, 105 nt, Homo sapiens
gauucuccagggaccuuguugccuccuggcucagugggguccugguucucccagugggagucagaggcccacuguagcuugaugccuaaggagagcuggaggauc

SEQ ID NO: 2242206 - RNA, 61 nt, Homo sapiens
ccaaugagagguaucagauccuuauccaucaucuucuuggaucuugguauagucuuauugg

SEQ ID NO: 2242207 - RNA, 91 nt, Homo sapiens
uggcugggucaaaugguauuucuaguucuagauccuugaggaaucaccacacggccuuccacaauggcugaacuagauuacagucccacca

SEQ ID NO: 2242208 - RNA, 55 nt, Homo sapiens
uugagauggagucucacucuguggcccaggccagagugcaguggcaccaucucaa

SEQ ID NO: 2242209 - RNA, 79 nt, Homo sapiens
gugcauuuagaagcauugauccacaggcgugcuauuacucagcacuccuguggauacaaugauaaacuucacucagcac

SEQ ID NO: 2242210 - RNA, 59 nt, Homo sapiens
cacgguaagaucagugaauuucaugagcaugggcccacugcugcacuucuuuugcugug

SEQ ID NO: 2242211 - RNA, 67 nt, Homo sapiens
gcucuuuguaugucaugacaacugugccaauuauuuuuggcacaguucacuuuuuauaucaaagagc

SEQ ID NO: 2242212 - RNA, 84 nt, Homo sapiens
uauuuauauuuguauuaacuaucuccacagaagucauuugcaacaaauugaauggaacuggagaugguuauauuaaguaaaaua

SEQ ID NO: 2242213 - RNA, 56 nt, Homo sapiens
aggauuagagacuucucuaccucaguuuuaacugagaguuuuauggcuuuaauucu

SEQ ID NO: 2242214 - RNA, 73 nt, Homo sapiens
gaagacaguggucaguugaguccuugccaagccaggcuggcuucgaggaggagugauugaggcgauuguuuuc

SEQ ID NO: 2242215 - RNA, 85 nt, Homo sapiens
ggaggugaugaaaucaugaggguauagccagcccuuagcaaacacugaaacuacuuguacccugaucuuggauuucucagccucc

SEQ ID NO: 2242216 - RNA, 75 nt, Homo sapiens
gacaugaauuacuuggaauucuuuugcaaaggagauugucuauuucuuuuugagucaguuucgguaguauauguc

SEQ ID NO: 2242217 - RNA, 55 nt, Homo sapiens
cugggucaguuucugauuauugauuuaagacucauuugaauggaaauuggccuag

SEQ ID NO: 2242218 - RNA, 85 nt, Homo sapiens
auacccaguaaugagauuguuagaucaaaugguauuucuggugcuagauccuucaaccauugucuaaauaguuuuuuaauggugu

SEQ ID NO: 2242219 - RNA, 77 nt, Homo sapiens
accuucuuugaagcagaaagauggugaauaugguaauuuuuauggcuuacuaccagcauuucucuuuaaguaaaggu

SEQ ID NO: 2242220 - RNA, 71 nt, Homo sapiens
aaaacuagugaaaucugaagaaggucaugccugaguuaacaguaucaugcugaugucaauuuccugguuuu

SEQ ID NO: 2242221 - RNA, 97 nt, Homo sapiens
gcuggcagugagaauuucaagucaguggaucuuagcucgcugggcuccauggggaugggauucacugagcuagaucacuugacuuccugacuucagc

SEQ ID NO: 2242222 - RNA, 64 nt, Homo sapiens
ggagaccucaguucagucuuacacaggcuucuuaccucaggugagucacuuugcuggggucucu

SEQ ID NO: 2242223 - RNA, 59 nt, Homo sapiens
uucuggccauggcuucuuucacaguagacaaugccucuuaagaagugcauggucuagag

SEQ ID NO: 2242224 - RNA, 94 nt, Homo sapiens
uagcccaugagagagguuuugcccucgagauaaacuguagcucuaaauuucuuuuaaguuguuagggggaaaaaaucuauuucaguacuugcua

SEQ ID NO: 2242225 - RNA, 61 nt, Homo sapiens
auguaaacauuuggucuaaauugugcaggucagauauaacguaggcuaaaugcuuuaucau

SEQ ID NO: 2242226 - RNA, 84 nt, Homo sapiens
aguacauuguaauuugaucacauuguuucauacauauucugggacauccuaaaauuguacaugcagugagucaucuuacgugcu

SEQ ID NO: 2242227 - RNA, 74 nt, Homo sapiens
gcuugagcccaggaguuagcgaggcuguagugagcuaugauuacacuacugcacuccacccugggugacaaagc

SEQ ID NO: 2242228 - RNA, 59 nt, Homo sapiens
ugugaacagaauuagucaccuaaucacaggagugacuucgaucccagguucuguucaca

SEQ ID NO: 2242229 - RNA, 71 nt, Homo sapiens
cagccaacuacagguaugaaagggaguaucuauaaagagagaucuccuugggugagccuguguuaggacug

SEQ ID NO: 2242230 - RNA, 60 nt, Homo sapiens
auguaauguuaaauugcuaauuugagaucuuucuuucugaaauaggcuuuagcauuauau

SEQ ID NO: 2242231 - RNA, 68 nt, Homo sapiens
gaaaaagugaccuaacaaugaaggccauucagaaugaugaaggcuuccaagcacuaguguucuuuuuc

SEQ ID NO: 2242232 - RNA, 81 nt, Homo sapiens
gaaauaaacagcuuuauugcucacacaaagccuguuugguggucucuucacacggacgugagugaaaaaacuguuuauuuc

SEQ ID NO: 2242233 - RNA, 88 nt, Homo sapiens
aguguguccauguuaaaugcagauuccuaggccccauugacuagcccaggauguggguggaccugggaaucugcauccuuagcacgcu

SEQ ID NO: 2242234 - RNA, 85 nt, Homo sapiens
cuccaacuuugaaagaaguucuacuguggguaaaaugcuauccaguagcaucacacacuacagggaaaucuuucaugaaagggag

SEQ ID NO: 2242235 - RNA, 57 nt, Homo sapiens
gucucucaaaacuagaagagaaagguguuuuuuccacaucagucuaguuuugaagac

SEQ ID NO: 2242236 - RNA, 66 nt, Homo sapiens
cucugcaggcacccagggcagguuacacaggaauugccugaagcuggucucaggugcccugcugag

SEQ ID NO: 2242237 - RNA, 56 nt, Homo sapiens
cauuugcauaauaagauugggggggagaccagccuuccccgcauacuauguaaaug

SEQ ID NO: 2242238 - RNA, 72 nt, Homo sapiens
gaaagcccugccuggggggaaguagggggcagcuuuugucuuccccugagaccccucagcacugaaguuuuc

SEQ ID NO: 2242239 - RNA, 72 nt, Homo sapiens
gcuaagcuucauacaguggcugcacuccagccaguaaaaaggcuggagugcagucacuguguguagcuuagc

SEQ ID NO: 2242240 - RNA, 75 nt, Homo sapiens
uauuagguuggugcaaaaguaauugccauugaaagucauggcaaacacugcaauuacuuuugcaccagccuaaua

SEQ ID NO: 2242241 - RNA, 87 nt, Homo sapiens
aaguaguccaaagaaucauuguuucuaaguuugugagaaaggauguugauaguuugauaggaacaauggugaaucuguagauugcuu

SEQ ID NO: 2242242 - RNA, 76 nt, Homo sapiens
ugucuguauaaaaaucacuuugcuacaaggcaguuaguuacuaaucugaccaaccggcuggagugaaggugagaca

SEQ ID NO: 2242243 - RNA, 62 nt, Homo sapiens
gugagcugcuugggauaucagagaaguuuaaaaacuucucugguuuucaaagcaguauuugc

SEQ ID NO: 2242244 - RNA, 87 nt, Homo sapiens
ggagaaucgcuuaaacccgggaggcagggguugcagugagccaagauugcgccacugcacuccagucuggcgacagagcgagacucc

SEQ ID NO: 2242245 - RNA, 72 nt, Homo sapiens
guugcagugagcgaagaucacaccacugcacaccagccugggugacagugugagacuuugucucaaauaaau

SEQ ID NO: 2242246 - RNA, 86 nt, Homo sapiens
uagugguaacaguggaugggcugcucucaggcuggggagcacacacuuuguucccuguguccugggggcaccucccugauaugcua

SEQ ID NO: 2242247 - RNA, 58 nt, Homo sapiens
gugugacuagucaugccugaauuccaccaagaaagcaccaggccugucuagcucacau

SEQ ID NO: 2242248 - RNA, 88 nt, Homo sapiens
guaauuaagaucugaguccugaagaccuuccucuggagccucggugaauugacuuaaucuagauggguccaggugcuggggugauuac

SEQ ID NO: 2242249 - RNA, 108 nt, Homo sapiens
caaaaauagcgagguagagcagaugggagaaaauauuaucaguuguuacaucuaaguggagggacuagagcugaucauguuacuguuauuucuacuuuucuguguuug

SEQ ID NO: 2242250 - RNA, 76 nt, Homo sapiens
ucuggagcaugcuuccauaguauuuuuacaaaauccaaaagacuuuuguccaauagaauuauggacauguaccagg

SEQ ID NO: 2242251 - RNA, 75 nt, Homo sapiens
ccugcuacugugccuggcauauauagucaaagcucaauaaacggugguggugguaauacuagucauaguagcagg

SEQ ID NO: 2242252 - RNA, 78 nt, Homo sapiens
auguuuacauacuuuggaaguguguauguauagcuauauugaaauaguuuuugugaaacuuucaauuuauguuaucau

SEQ ID NO: 2242253 - RNA, 97 nt, Homo sapiens
ccaguaggacugugaaauauaacugagacaagguccuagguaaugugauucuuuugccuaggcccaguccucagaaaggauuuugacauaucccugg

SEQ ID NO: 2242254 - RNA, 79 nt, Homo sapiens
guaaacuuuagaaaugugacugccacucaguuuagagggaaaggcauuccugugugguaguagaauuucggaaauuugc

SEQ ID NO: 2242255 - RNA, 61 nt, Homo sapiens
agucccguagcaggaaaccuguguugagggaggcucuuuucauucuuuucuugcuggggcu

SEQ ID NO: 2242256 - RNA, 87 nt, Homo sapiens
cccguuccacccugcugcgcacagugaagagguaaguccagccaugggacucucaucucaguggugcuggcaggggaggacauuggg

SEQ ID NO: 2242257 - RNA, 64 nt, Homo sapiens
ucagaagauuggcacuuauuagcacccugagcuaccuaaaagaauaagugcuugagacuucuga

SEQ ID NO: 2242258 - RNA, 123 nt, Homo sapiens
cuuaucauuaacuguaacuuaguuagcgugauauuuuugauccuuaaguuuuuaacaucguauaaagaauuuuccauccaaaguaacaugaggcagagcuaccugaauuucaguggugauaag

SEQ ID NO: 2242259 - RNA, 59 nt, Homo sapiens
aacagagaauaacaagcguugggaaggacauagagaaauuggagcucuuguucucuguu

SEQ ID NO: 2242260 - RNA, 75 nt, Homo sapiens
cugaauaaaaagaagacuucuuuaggcuuuaauguuuucuauguuauagcacugaaagaggugauucuuauucag

SEQ ID NO: 2242261 - RNA, 70 nt, Homo sapiens
uguauuacagugguugcuauugugaauaaacaucuucuauuauauauucuuaauuuauuauugugguaca

SEQ ID NO: 2242262 - RNA, 81 nt, Homo sapiens
gcugaggcaggagaauggcgugaacucgggagguggagcuugcagugagccaagaucgcgccauuguacuccagccugggc

SEQ ID NO: 2242263 - RNA, 61 nt, Homo sapiens
ugcaagaaucuuucaggcuagcaugaaacaugagaaacacauagaugagagauucuuugua

SEQ ID NO: 2242264 - RNA, 91 nt, Homo sapiens
aggacugugguggacuugggggguucucaagaucaagugacccuccggagucuuuugcacuugaaaacacucucauucuccaccuguaccu

SEQ ID NO: 2242265 - RNA, 69 nt, Homo sapiens
cuugaacucaggagguggagguugcagugagcugagauugcgcuauugcacgccagccugagcaacaag

SEQ ID NO: 2242266 - RNA, 93 nt, Homo sapiens
ugucacuugccucauccaaucugcugacuuuagaacccaaaaaguuucuuugguaugggcuuuuggagcugaauuacaguggagggcaugaug

SEQ ID NO: 2242267 - RNA, 84 nt, Homo sapiens
uuucaguucuuuugcacuugcugaggagugauuuacuuccaauuaugugaucaauuuuagaguaagugucaugugacacugaga

SEQ ID NO: 2242268 - RNA, 59 nt, Homo sapiens
guauugucuauggcugcuuucaugcuacaacagcagauuuaaguaguugugacagaugc

SEQ ID NO: 2242269 - RNA, 55 nt, Homo sapiens
cuccagucuuguuuccuaccuaaugaguuagucagaauaggaacauugauuggag

SEQ ID NO: 2242270 - RNA, 58 nt, Homo sapiens
gggcaacauugaguacccugaacuugucaagaagcuaacagggucugcuucugugcuc

SEQ ID NO: 2242271 - RNA, 77 nt, Homo sapiens
ucacuugaacccaguagguggagguugcagugagccaagaucacgccauugcacuccagccuaggcaacaagaauga

SEQ ID NO: 2242272 - RNA, 55 nt, Homo sapiens
uucauggcauuucaagauuuaccagcuuuguagguggugauagaaaugucaugaa

SEQ ID NO: 2242273 - RNA, 76 nt, Homo sapiens
aguuccuugagucuuuuuccugaguacccaaaguuggggugaagagcacucuaggaaauuuaagucuuaagcaacu

SEQ ID NO: 2242274 - RNA, 85 nt, Homo sapiens
ggccagcuucaggcuuuguuacccucacucuaaagugauagagauucucugacaucuucaagugaggagagcagacgccugggcc

SEQ ID NO: 2242275 - RNA, 58 nt, Homo sapiens
cuagcaguauaugagagcuauuguuacucuaaaccauaacaacucuugauacuguuag

SEQ ID NO: 2242276 - RNA, 70 nt, Homo sapiens
gcauucaaaccgcuggcuauauccuugccaaaguauauaacuuuggucaaaauaaguaaguugucuaugc

SEQ ID NO: 2242277 - RNA, 77 nt, Homo sapiens
uuauuagguugguggaaaaguaacugccauaacuuuuaauggcaaaaaccacgaguacuuuugcaccaaccuaauag

SEQ ID NO: 2242278 - RNA, 68 nt, Homo sapiens
gugacaauagauauaaggaaccuuugcaaacuagaguguguuaugcaaauguuaggugucauuaucau

SEQ ID NO: 2242279 - RNA, 76 nt, Homo sapiens
uguugaguuaugccaaaaguaggccccaacagguuuugaaaggcagauguuugguaagaauauuguuaauucagca

SEQ ID NO: 2242280 - RNA, 58 nt, Homo sapiens
uuggauagugcaaugccuccagcuuuguucuuuuugcuggauuguguuggcuauucag

SEQ ID NO: 2242281 - RNA, 77 nt, Homo sapiens
uauuagguuggugcaaaaguaauugugguuuuugccauuauuuucaaagcugcauuuacuuuugcacaaaccugaua

SEQ ID NO: 2242282 - RNA, 74 nt, Homo sapiens
aauauugggagguaggaguuauuauuuucucuaucuuacaaaggaggaaguugaggucucuaucucuuacuauu

SEQ ID NO: 2242283 - RNA, 67 nt, Homo sapiens
uaagucuucuuuuuuccuguguauuuguuauguuguaaugaaaaaauacaaggaaugaagagauuug

SEQ ID NO: 2242284 - RNA, 91 nt, Homo sapiens
ggucagggcauuugaacuaauaacugugcuggcaccuauuacuggugcuuguauuaucuuaggcaaguugcuauucuuuaaugccuugauu

SEQ ID NO: 2242285 - RNA, 78 nt, Homo sapiens
guuuggaaaccuuguagccacagguggcuaggaaauuuaagagugcuuggguggcuugauggcacaagguuucugaau

SEQ ID NO: 2242286 - RNA, 88 nt, Homo sapiens
uccauggugcaugaaaucccaaauccguucacuuuuuuacuaaauuagauggagcaaaacagauuugggaauucaucuuguucauggg

SEQ ID NO: 2242287 - RNA, 63 nt, Homo sapiens
ugguucugaaagcgaggaagcacaugaucuggguugcauuugcaccuaguguuucuugaauca

SEQ ID NO: 2242288 - RNA, 61 nt, Homo sapiens
aacaguagugggcuacagaaucagaaaucaaaagaacugucuguuaaaugcccauucuguu

SEQ ID NO: 2242289 - RNA, 69 nt, Homo sapiens
uguugccuaggcuggagugcaguggugcgaucucgguucacugcaaccucugccucccagguucaagca

SEQ ID NO: 2242290 - RNA, 83 nt, Homo sapiens
gaggggagaggugcuugaaucuaugagcucagcucguuaccuugagccagaggccucauuuagauuuaaguacuacucuuuuu

SEQ ID NO: 2242291 - RNA, 72 nt, Homo sapiens
aaacauaagcaugcuucuacuuuaguuaucacuuugaauuugauuuuuaagguaugugggcauuuuguguuu

SEQ ID NO: 2242292 - RNA, 95 nt, Homo sapiens
ugccaacacauugauuuuggacuucuagccuccagagcuguaagacaauauauuuucuguuguuugaagccagaaagauaucauguuauuuggca

SEQ ID NO: 2242293 - RNA, 59 nt, Homo sapiens
ugagagaugauaaaauguuuguugucugaaucaacuacauuucgaaaugucauuucaca

SEQ ID NO: 2242294 - RNA, 57 nt, Homo sapiens
ugagacggagucucgcacugucgcccagacuggagugcaauggcagaucuccgcuca

SEQ ID NO: 2242295 - RNA, 75 nt, Homo sapiens
agaaagcucacuuugccugagaagccaagaauaaacagauuuuguuucguguuuuagagcaaaaugggauguuuu

SEQ ID NO: 2242296 - RNA, 63 nt, Homo sapiens
auccuggaacuuuacugaaguuguuuauccguuccaggaacccuuugguagaguuuuuagggu

SEQ ID NO: 2242297 - RNA, 106 nt, Homo sapiens
caggauguagaucauugaucccuaccauugcugagacauugcuaaucugauauuuauccagagcgcacugucugcaggcaaauuaggguuuuaauucaccaucuug

SEQ ID NO: 2242298 - RNA, 55 nt, Homo sapiens
gguugugguuccauuuguauucagucaauauggaggcaaauggaucccacaagcc

SEQ ID NO: 2242299 - RNA, 69 nt, Homo sapiens
uauagcuuuuuagggaauuuggguaaacucagugagcgugggugagucaaauggacuggggugguuaug

SEQ ID NO: 2242300 - RNA, 56 nt, Homo sapiens
ugagucagucucacucugcugcucaggcuguaaugcagcagggagaucuuggcuca

SEQ ID NO: 2242301 - RNA, 87 nt, Homo sapiens
ggcugggaaggagaggaagaggaggcccucgcugggauuuauuuuucuggaggcgcugagacgucuucucuucuucaaagcucaguc

SEQ ID NO: 2242302 - RNA, 80 nt, Homo sapiens
agaggcugucuggagucuguucaauguuaucgcguaauacacagugacuuuuuuauugaaggcacuccaugauucccucu

SEQ ID NO: 2242303 - RNA, 71 nt, Homo sapiens
uguuccugguucucauuagcuucccauuagaauacaguaaggcuagcaagaugagaauaaucuuuggagca

SEQ ID NO: 2242304 - RNA, 123 nt, Homo sapiens
gguauguucaucuucaaggaugucaggaugauuuggggaggugcagucccuccugccccugccccuacauuacuggcuuuccucuugcaccugaagcuuuuuccagaucaaaauggaugugcc

SEQ ID NO: 2242305 - RNA, 61 nt, Homo sapiens
augccuauuaaaguugacauuuugaccaucuaccauaagucaugaauguccuugauggcau

SEQ ID NO: 2242306 - RNA, 57 nt, Homo sapiens
uucagguacuauaggcuguuggucuauauauccggccaacaguauuuagcuccugaa

SEQ ID NO: 2242307 - RNA, 79 nt, Homo sapiens
ucuguauuucuuccccuagcauauccauauauucuagaacucuggauauguucuuuguguaaggugaacuuaguucaga

SEQ ID NO: 2242308 - RNA, 68 nt, Homo sapiens
uuccuugaaggcagcagcuguauuuuauuuaucaauguauucccaaugccacugugccugccaaggaa

SEQ ID NO: 2242309 - RNA, 123 nt, Homo sapiens
guuaaugacccucagaacagccuuuaaccaaaggaggaugggauguaaaauucuguagccuaugggaggaugggauguagccuucuauuuuccaggugguaauucugggugguguucuuuagc

SEQ ID NO: 2242310 - RNA, 74 nt, Homo sapiens
uggaaaguaguucuaaucuaaggacuuuauuuccccuacauuugucccuuuggaaauuuggaauaacuuugcca

SEQ ID NO: 2242311 - RNA, 83 nt, Homo sapiens
uggcaggcuagagucucucauuaaucuguauuuucauuuuaaaaugaguacuuugcauuaguaaguaauuuuaauuuuugcca

SEQ ID NO: 2242312 - RNA, 70 nt, Homo sapiens
uucauacuuuaaaauagggcaccauuuuuauuuagcagaauaaguaguccugauuuaaccuugguaugga

SEQ ID NO: 2242313 - RNA, 86 nt, Homo sapiens
guacguuuguuugguaaaagaggacgugcuauuuuuuacaguuaaaucuaauucguaaguuguagaacguuuucuuaacaagguau

SEQ ID NO: 2242314 - RNA, 89 nt, Homo sapiens
ggccgagagcuuucuucuuuucccuccaaccucaucuuuguguccacgcuccuuaauguucuuggagguaggacgaagaacucuggguu

SEQ ID NO: 2242315 - RNA, 65 nt, Homo sapiens
gaaccaugcaguauuugccccucugugacugguuuauuucacauagcauaaugucugcaagguuc

SEQ ID NO: 2242316 - RNA, 86 nt, Homo sapiens
ggcuaacacuaucugccuuacagggaugccaugagaauuaaauggaauaaugccucugaggaagauuguguuuucuaaaaauggcc

SEQ ID NO: 2242317 - RNA, 74 nt, Homo sapiens
ccucaugguuuuguuauaugaauuaaaaauguuuaaaaauuuugucauuugugaaacauggauagaacuggagg

SEQ ID NO: 2242318 - RNA, 60 nt, Homo sapiens
ugguagugugagucuaaauugguucaacuucuauagagagaaauuuggcagcaucuacca

SEQ ID NO: 2242319 - RNA, 130 nt, Homo sapiens
uauugucuuggcccagguaugagagucauugccuuaccuguguuuugggcccagauauguguuacaauuugagcucugggcaggacccaggaagaagagucacaucaccuaggugcugaguccagcaaua

SEQ ID NO: 2242320 - RNA, 56 nt, Homo sapiens
ucgguauuuuagaauugagacuacauuucuaguaguauucucaguuuaaaggcuga

SEQ ID NO: 2242321 - RNA, 87 nt, Homo sapiens
uguauugagguauaauugacaagcaaaaauuguuuauauucaagauguauaauguuucguuuuguuguaauauaccuauccagugca

SEQ ID NO: 2242322 - RNA, 93 nt, Homo sapiens
aucugccuugaucauagagaaacuaagccaaggcuuauuugguuuugaugucuagcacagugguuaaguuucuuauuuucaaguucagcaggu

SEQ ID NO: 2242323 - RNA, 56 nt, Homo sapiens
gacccaugauuauaucuuugacccuaaguucagguauaagcauaguugucaggguc

SEQ ID NO: 2242324 - RNA, 62 nt, Homo sapiens
guaucaugcuguuuugguuacuauagcuuuguagcauaauucagaguuaggcagugugauac

SEQ ID NO: 2242325 - RNA, 76 nt, Homo sapiens
ggggggauggggcuugggggagaacaguggccaagggcuuccccgcagcugauugucucuccugccccaucucccc

SEQ ID NO: 2242326 - RNA, 59 nt, Homo sapiens
guuuaggaaugagaauauuuaguuguuucuauuagcuagagcaaccugauucacuagac

SEQ ID NO: 2242327 - RNA, 64 nt, Homo sapiens
ucuguaacauccaccuucuggguuccagcgauucuccugccucccaaguagcugggauuacagg

SEQ ID NO: 2242328 - RNA, 61 nt, Homo sapiens
ucagugcuuaguacuaacagguccucaauguacauuuauggaauguuaaagacuacacuga

SEQ ID NO: 2242329 - RNA, 67 nt, Homo sapiens
agagguaagaauaguaguuggaaugaccugaaaugcaaacaaggucuccugaaacaauuuuuccucu

SEQ ID NO: 2242330 - RNA, 78 nt, Homo sapiens
guggggacuggcccaggcucuuucuagcugcuuuaggguaggcaaagcagcuuugcauggccuguggccaguccucac

SEQ ID NO: 2242331 - RNA, 56 nt, Homo sapiens
cccgggagguggagguugcaaugagccaaaaucaugccauugcacaccagccuggg

SEQ ID NO: 2242332 - RNA, 81 nt, Homo sapiens
uaggcauugaacuaucccuguucauggugauuuucagaauaagacugagaugugaucaccugaaggguguccuaaugcuua

SEQ ID NO: 2242333 - RNA, 56 nt, Homo sapiens
ucuucugccugcugcaggaucuagauuccccucucuagaaccuguaguguagaggg

SEQ ID NO: 2242334 - RNA, 65 nt, Homo sapiens
gagcacauguggagagucugggcccaguccuugcucugggaucugccucauucucgcguguguuu

SEQ ID NO: 2242335 - RNA, 58 nt, Homo sapiens
guugcuauugugaauagugccacaauaaacauacgugugcauaugucuuuauggcagc

SEQ ID NO: 2242336 - RNA, 93 nt, Homo sapiens
uuuuaaggacguaugaauauggaguuuacuuaguguaauauuuguguuacacccacaaaaaauuccaaauugcagauguuuuauaccuuaaag

SEQ ID NO: 2242337 - RNA, 77 nt, Homo sapiens
ggagaacuuuugugucuagcucagggauuguaaacacaccaaucagcacccugucaaaauggaccaaucagcucucu

SEQ ID NO: 2242338 - RNA, 73 nt, Homo sapiens
agcccccagcacauuacaaguacuugguaggcacccaaaauuuauuaaauaucuguaauuuguugauaagguu

SEQ ID NO: 2242339 - RNA, 55 nt, Homo sapiens
gcauguucaaguuaguauauuugagguugaacuaaaugugcuaauauuaauaugu

SEQ ID NO: 2242340 - RNA, 57 nt, Homo sapiens
uuuguaacaugcuuucacuucaguuaaagcagaaacugaugugauauaugugacaga

SEQ ID NO: 2242341 - RNA, 59 nt, Homo sapiens
gucaauauauuucuuacccaauuuuaacucccuggagauggagugaagaguuuauugac

SEQ ID NO: 2242342 - RNA, 56 nt, Homo sapiens
caugaauuagcaauggugugcagggaaggaaccaguaucaccacagcucguucaug

SEQ ID NO: 2242343 - RNA, 55 nt, Homo sapiens
augugacagugguuuuaagcguccuggcaaugcggaucuuagcuacuggauacau

SEQ ID NO: 2242344 - RNA, 126 nt, Homo sapiens
ggaagggaugaaggugauagggucuccuuggcaaagagacaugcaucggggcuuugacaaacaugaguccuccuuguuuugucucugcugauuaaugaggagaugcugccaucuuucuuuacuuuc

SEQ ID NO: 2242345 - RNA, 65 nt, Homo sapiens
uaaaagguugaguauagggauuacuugggauccuucuuuguaagacucuggacucuaauguuuug

SEQ ID NO: 2242346 - RNA, 66 nt, Homo sapiens
cugaccuaugauuuggcucaaagucauucaagacuggggcauggcacugacuaagcuauggguuag

SEQ ID NO: 2242347 - RNA, 81 nt, Homo sapiens
uucuauacacaaacacauuuuugucauauugguauuuacaacaguuccaagugggaaacaaaaauguccaucuguagggga

SEQ ID NO: 2242348 - RNA, 117 nt, Homo sapiens
gugugacuaggacgccucugugcauggauuuuaagauugugauguucagcagugugacuaggacgccucugugcauggauuuuaagauugugauguuuagcagugugacuaggacgc

SEQ ID NO: 2242349 - RNA, 62 nt, Homo sapiens
uugcaugcaaaucuuaaguauguguguauaaauauacauauacugagugauuugcuuugcaa

SEQ ID NO: 2242350 - RNA, 62 nt, Homo sapiens
ugaccugaaauaugagggugaugcccagagccaguuuuggcagaugacccucaaguugguca

SEQ ID NO: 2242351 - RNA, 91 nt, Homo sapiens
gggggccccauauuuacauuucauacuaaggcucaaaaaucauguagcugguuuugcucuugguaaugaaagacuccuugaggugguuccc

SEQ ID NO: 2242352 - RNA, 63 nt, Homo sapiens
auccauucugacugguguccuuauaagaagaugagguuaggauacagacacagucagaggggu

SEQ ID NO: 2242353 - RNA, 80 nt, Homo sapiens
agugugagccaguuuggcuaauuuuggcuaauuuuuguagaaacggggucucgccauguuggccaggcuggucuccaacu

SEQ ID NO: 2242354 - RNA, 56 nt, Homo sapiens
cgccuauuacuuuuuuuccaauuucaauuaggaacauggaaguaagaauauaggug

SEQ ID NO: 2242355 - RNA, 84 nt, Homo sapiens
caggugaggagaagagagguugguguccaggggagauggacaaaucucuuucuuuggauggaaccucucuuucuuccuccucug

SEQ ID NO: 2242356 - RNA, 100 nt, Homo sapiens
ggacacuuuucuagauagaaggagaaggagugugauucuucaguuuuauucucaaugaaauuaaguuauaauacuuuuuguccugaagucuacuuugucc

SEQ ID NO: 2242357 - RNA, 98 nt, Homo sapiens
gacaagucccagcucccuuugggccaugguuuguguauaugucaagcaggaguaaugcuuuguaugcagcccaucucacagggaauuguggagcuguu

SEQ ID NO: 2242358 - RNA, 103 nt, Homo sapiens
acuagacuguuacaucugaagguuaaauuuauguaaaagucuuuuguccuaacugaugaauagaaaucuguuugcugagucugacuucaugguacaguuuagu

SEQ ID NO: 2242359 - RNA, 71 nt, Homo sapiens
cagguaaugcuggugcuagaaacuggaagcagaaagauuucuacaguuacucagcucgguagagauaccug

SEQ ID NO: 2242360 - RNA, 58 nt, Homo sapiens
uuucugugaggauuuuaacaugagagucugcucaucacacgugaacucaucacagaga

SEQ ID NO: 2242361 - RNA, 57 nt, Homo sapiens
agucauuauguuuugggcgauuuguuaugcagcaauagagaacugaaacaugugacu

SEQ ID NO: 2242362 - RNA, 58 nt, Homo sapiens
cuuugggagaaacguaguuuauaguuuaaacaaagacaguaacagcacuuucccaaag

SEQ ID NO: 2242363 - RNA, 103 nt, Homo sapiens
uugagacaggguuucaugcuguugccuaggcuggagugcaguggcacaaccuuggcucacugcaaucuccgccucccagguucaagugacucucaugccucag

SEQ ID NO: 2242364 - RNA, 84 nt, Homo sapiens
gccauuuucggagaagaagguucgagagcacacguugcacuuguaauucccuuuaaugagcucagcuuucuuuuucacgauggc

SEQ ID NO: 2242365 - RNA, 57 nt, Homo sapiens
gaaguucacagugacuuauauuuugauauacagauauuugguuaccugugggucuuc

SEQ ID NO: 2242366 - RNA, 59 nt, Homo sapiens
auuguggucagaaaauuacuugauauuauuucaauguuuuggauuuuuuuggccauagu

SEQ ID NO: 2242367 - RNA, 56 nt, Homo sapiens
cuucuuuucuaauugcagcuguaaagaagaaaguccagcuguuguuaaaaaggagg

SEQ ID NO: 2242368 - RNA, 65 nt, Homo sapiens
augauguugggauaacuggcuagccauaugcagaagauugaagcugggccccuuccuuacaucau

SEQ ID NO: 2242369 - RNA, 83 nt, Homo sapiens
gguaaaugaaauaaggcagucacuaaauagugagaaaagucaccuauuuacucauguucagaugacucccggguuucagaauc

SEQ ID NO: 2242370 - RNA, 60 nt, Homo sapiens
augaugaacugucuuacuacucacugaaggcuuucagagaaagagcaagacagucaucau

SEQ ID NO: 2242371 - RNA, 129 nt, Homo sapiens
gcccaugaucugggcccgcccccaucgugcccauguccagcgcguggcugccauugugccuguguccagcacauggccccaucgugccgauguccagcacauggcccucaucgugcccaugaucugggc

SEQ ID NO: 2242372 - RNA, 70 nt, Homo sapiens
auuccuaaggcuugcuucagucuugaaaauauaggaucacguaucuuagaagauuugcaguuuuggggau

SEQ ID NO: 2242373 - RNA, 60 nt, Homo sapiens
ccuaaccuauaguauugaaaucaagucgauuuuugucauuugaaguaacuaaggguuggg

SEQ ID NO: 2242374 - RNA, 70 nt, Homo sapiens
auauccuugccaauacuugcuaucuuuuggcuuuuugguaauagcuauccuagcaggugucaggugauau

SEQ ID NO: 2242375 - RNA, 76 nt, Homo sapiens
cggucaacaaagaugaaagugcugcaaggccaugcauggugacucacgccuguaaucucagcacuuucguaggccg

SEQ ID NO: 2242376 - RNA, 58 nt, Homo sapiens
uggcaccaggugcccagcacggccacgcccaccuggcuggccugccgcaccugggcca

SEQ ID NO: 2242377 - RNA, 62 nt, Homo sapiens
uucaucuggcaauucagagauuuauucuuggugcggauuuauuucuggagagcuagugugaa

SEQ ID NO: 2242378 - RNA, 99 nt, Homo sapiens
gagguaggagaaucgcuugaacuugggaggcagagguugcagugagcugagaucaugccacugcgcucuagccugggagacagagagagacuccaucuc

SEQ ID NO: 2242379 - RNA, 78 nt, Homo sapiens
gcaagacacuggcuuuugagaaaaacacugguuuuaugaaugccaaguuucauuccucacaagccuucucuucuuugc

SEQ ID NO: 2242380 - RNA, 76 nt, Homo sapiens
gaucucagcucaccacaaccuccgccuccuggguucaggcaauucuccugcuucagccuccggaguagcugggauu

SEQ ID NO: 2242381 - RNA, 60 nt, Homo sapiens
cugccuaaccauuggugaaggaucugccucccacccccaccucccaauguuuccaggcag

SEQ ID NO: 2242382 - RNA, 128 nt, Homo sapiens
ccggauccugcuuugaagcaguggggaaagggaagcccagugguugggccggagacggggcuaggggugcacccuucgucccggucagcucuugcggcugccuacguuccuucaccugccaggaccgg

SEQ ID NO: 2242383 - RNA, 95 nt, Homo sapiens
auguucugaaguacugaggguuagggcuucaacuuacgaauuuggugaguucacaguucagccuguaacacauuucuucaggauuuccagagcgu

SEQ ID NO: 2242384 - RNA, 76 nt, Homo sapiens
ccucaucccauucgaggggcacagcuggaggagggccagagcgggcucucugcuguccucuugggugggaucaagg

SEQ ID NO: 2242385 - RNA, 60 nt, Homo sapiens
uuuugcucuucauagguccuguuuuugcuugcacauuuaauaguagguggagaugcaaaa

SEQ ID NO: 2242386 - RNA, 80 nt, Homo sapiens
aggguucaguggagugggucaaaaugugcuaguugugggugggacuccacagugugucaccauugagucauuuccucccu

SEQ ID NO: 2242387 - RNA, 68 nt, Homo sapiens
aaguuccaaugcacauaaaauccuccagggugcauuuuuacuuuggaagugggugugugugguaacuu

SEQ ID NO: 2242388 - RNA, 64 nt, Homo sapiens
guugaguuacauuguaauugccgagacgcaggauggcaucucugcaauuagaauguaauauaau

SEQ ID NO: 2242389 - RNA, 93 nt, Homo sapiens
ggagaaucacugaagccuggggggcaggguugcagugagcugagaucgagaucaugccacuguacucuagccuaggcgucagagcaagacucc

SEQ ID NO: 2242390 - RNA, 57 nt, Homo sapiens
aaagcugugaaauggagaaaauggggaagcugaccauuuugcacacuaugcagcuuu

SEQ ID NO: 2242391 - RNA, 84 nt, Homo sapiens
uuuccuuuuucauuugggauggcuugauucguucugagaugugaggucuagaaugaaacaagcugugccugaagggacaggaga

SEQ ID NO: 2242392 - RNA, 81 nt, Homo sapiens
ucugaaagauuggcuuuauacauaagaauaaggacuauauccaucaauuucuuuuucuuauggugaagcacaaaugucaga

SEQ ID NO: 2242393 - RNA, 57 nt, Homo sapiens
uguggaucuuauucagaaccaugaaggcaguaccucuaugagucugcaagaaccaca

SEQ ID NO: 2242394 - RNA, 59 nt, Homo sapiens
agcuccauauacuuaggauaguuuauguuaaauucuauacaucuggaguuccuggggcu

SEQ ID NO: 2242395 - RNA, 67 nt, Homo sapiens
guagugauccuuaauuauuacuuaggaauuacuuuaugauuugguaauauuuaaggacuuaagcuac

SEQ ID NO: 2242396 - RNA, 75 nt, Homo sapiens
uuagacggcuuauauuuuauccugcugagauggaggugauggccuaucugcacaggguggaaauugccuuucuaa

SEQ ID NO: 2242397 - RNA, 55 nt, Homo sapiens
uuuccgcagaugcucagcugagccagugcagcuggcucccugacaaauguggaaa

SEQ ID NO: 2242398 - RNA, 66 nt, Homo sapiens
ggauuguauuaccgaaguggagucccaaauucacccauucucagacuucagugcagguaacaaucc

SEQ ID NO: 2242399 - RNA, 64 nt, Homo sapiens
auugugaauggugcugcaguaaacauacgugcgcaugugucuuuauagcagcaugauuuauaau

SEQ ID NO: 2242400 - RNA, 63 nt, Homo sapiens
gucugcugccuuuuauucagauaugcccugccccuagagguggaaucuagagaggcaguaggc

SEQ ID NO: 2242401 - RNA, 93 nt, Homo sapiens
uggaaaugacuaaggacuaaacagugaucucaugcugauuaucuguaguuacaugagacugucgcuaguuucuucuauaggcuuacacuucca

SEQ ID NO: 2242402 - RNA, 64 nt, Homo sapiens
gaaaccacaguucagugcuuuuggggaccuacuacagauucagauacucauggaacuggguuuc

SEQ ID NO: 2242403 - RNA, 79 nt, Homo sapiens
ugugaucugugacaagacuacauaucccauugguauccacaggccauguggugauuugugguauuuguccucagugaca

SEQ ID NO: 2242404 - RNA, 70 nt, Homo sapiens
caucacacuuggauguaagacacuuugagccaauuccaaaaacccaaucugucuaaaccaaugugugaug

SEQ ID NO: 2242405 - RNA, 60 nt, Homo sapiens
gguaaguccagccucacauucuggccuuacaacucaacagcugugugacccugggcuacc

SEQ ID NO: 2242406 - RNA, 79 nt, Homo sapiens
gagaggccuaccuaagugauggauuaaagauuuuaagaaaguaucuuuagacuguaaugcauaauuuacuuacucucuc

SEQ ID NO: 2242407 - RNA, 123 nt, Homo sapiens
uauucagaaccacguuuagaggugaggaagauugguuuugcuuguguaaaaaucuggacagcuucauuugccaucugugaaauuuaucgagugagggccaaaccucugaaacacaucugaaua

SEQ ID NO: 2242408 - RNA, 88 nt, Homo sapiens
cugagaacuagucacacuuuguuuaaugauaugcugcacaaaccuuuggauccagauuugagcauguaguuuaacccuggcuaaucag

SEQ ID NO: 2242409 - RNA, 84 nt, Homo sapiens
guuagauucucauaaggagcaugcagccuagaucccuugcaugcacaguuuacaauaggguuugugcuccugugagaaucuaau

SEQ ID NO: 2242410 - RNA, 69 nt, Homo sapiens
uuaagauaaugguuuccagucccauccauguugcugcaaaggacaugaccuuggggaaccaugucuuga

SEQ ID NO: 2242411 - RNA, 79 nt, Homo sapiens
uuguggcccaagaaagauauuuaccccagggcauucuauaggcuucacuggugagaugucuuuccucuuaggccaucaa

SEQ ID NO: 2242412 - RNA, 102 nt, Homo sapiens
cguauaauugucccuuccaccuucuaacucccauguucaagcacaauccccaguaugauggcauuuggaguugggacuuuggcagguaauuagauauauaug

SEQ ID NO: 2242413 - RNA, 58 nt, Homo sapiens
auagaaccuacauucuuaacuguugcacuacacugugcaacuguacccugugggcugu

SEQ ID NO: 2242414 - RNA, 69 nt, Homo sapiens
gccaaucugugucacuguauaauauuuauuauuuuaauuaaagaaaauggauagugacauuuauuuggu

SEQ ID NO: 2242415 - RNA, 99 nt, Homo sapiens
acugccaacucaguuaagaagaacacauagagaaguuuuaucagcagccucuguucccaauggaagucucuguuaaguuucucuggcugaggacuuagu

SEQ ID NO: 2242416 - RNA, 66 nt, Homo sapiens
cacagaauaacgugucucucagggucguuuaaauuccaaagagaacuguuuacacguuaaucugug

SEQ ID NO: 2242417 - RNA, 60 nt, Homo sapiens
cugagguaauuuguugccaguagacuugccuugcacgaaauacucaaauaaguuccucag

SEQ ID NO: 2242418 - RNA, 66 nt, Homo sapiens
gagaaaguuccaggaaaucuuucucacuaauagccaaggaacugucuauuuccuggagcuggucuc

SEQ ID NO: 2242419 - RNA, 57 nt, Homo sapiens
uggguacugugaagauucaagaccaagacacuaugguucauaugcacugagugccca

SEQ ID NO: 2242420 - RNA, 99 nt, Homo sapiens
uugggauuugaaaugacaugauagguagaagauguuuucauaaagcugugcuaauaaaugucaggccucuucauuuuuuaugucucauacagauuuuga

SEQ ID NO: 2242421 - RNA, 56 nt, Homo sapiens
auugagggcacaucuaaggaaguuccccuccuggguccuuggugaugcccugcagu

SEQ ID NO: 2242422 - RNA, 76 nt, Homo sapiens
agaccuuugugagguggauagauugcaaaacuuuucucccauucucuagguugccuguucacucugauaauaguuu

SEQ ID NO: 2242423 - RNA, 99 nt, Homo sapiens
cuguccgcucuagcugcgggucugauuggacggcucuuagucaagcaucccugaauggaugccguuuaaggccccgcccauucaggccuggagugacag

SEQ ID NO: 2242424 - RNA, 60 nt, Homo sapiens
gagagauuagguaacugccuaaacucucacauauugagauuaaguaauuacccaacucuc

SEQ ID NO: 2242425 - RNA, 66 nt, Homo sapiens
aucugaugguuuuauaagggagaguuucccugcacaaauucucucuugccugcagccauguaagau

SEQ ID NO: 2242426 - RNA, 109 nt, Homo sapiens
uaguuuaguuaauauuauugugccaauguuaacaucuuaguuuucauaaauguaucauaguuauguaagauguuaacauugugaagagaugccaugauauucugugcug

SEQ ID NO: 2242427 - RNA, 75 nt, Homo sapiens
agucauugacgauaucaaggaaaugaagugauaaaauaaaguuucacuuuaagaaguuugauaugacaggagacu

SEQ ID NO: 2242428 - RNA, 64 nt, Homo sapiens
gucaucaucauuauuauuucugagacagaguuucacucuguuggucaggcuagagugugguggc

SEQ ID NO: 2242429 - RNA, 77 nt, Homo sapiens
caugugucagcaucaccaugucuaugauagggcaaaucaggucauugguguauggugauagcauaugauaucacaug

SEQ ID NO: 2242430 - RNA, 74 nt, Homo sapiens
uugacauccuuugugaaagccaacaacaagggucaauaguagcuuuuguaauccuauuccaaaggaauugucaa

SEQ ID NO: 2242431 - RNA, 62 nt, Homo sapiens
gcucucguaauucccuugugucaugggaggcacccagugggagauaagugaaucacgggggc

SEQ ID NO: 2242432 - RNA, 62 nt, Homo sapiens
ccagggucugucaggagcugguuccaacuaacaaggugaccacauuccacacaggcuuuugg

SEQ ID NO: 2242433 - RNA, 59 nt, Homo sapiens
ucgcugggaagacugaagugucaaaauuggaagcaaagaaacuaaagcuucucaaguga

SEQ ID NO: 2242434 - RNA, 58 nt, Homo sapiens
gucucuaaguaaacuugaaaggcauuguaggccauaaggauuucaagucuuaggugac

SEQ ID NO: 2242435 - RNA, 106 nt, Homo sapiens
guuuugucuuuaaugucuucauugacucauugguuuuucaggaguauauuauuuaauuuugauguacuuaagaauuagugauuucagaagagauacuugauaugac

SEQ ID NO: 2242436 - RNA, 71 nt, Homo sapiens
uuuauuaagcuguguggacuaugccucugacucagaaggguagguaggcccugguuacacacugacauaga

SEQ ID NO: 2242437 - RNA, 79 nt, Homo sapiens
gguuccuguaaucccagcuaccagagaggcugagacaggagaaucauuugaaucugggaggcugagguugcagugagcc

SEQ ID NO: 2242438 - RNA, 74 nt, Homo sapiens
uucccgggacuucauauuucccugugugcagauggguguugcuaacaaccccacucacacauggaccuggugaa

SEQ ID NO: 2242439 - RNA, 73 nt, Homo sapiens
ugacaaguaaacagucagcaccguaaguggagccuaauuagugcucaugaaaggucugcugcuauugcuguca

SEQ ID NO: 2242440 - RNA, 67 nt, Homo sapiens
cugauuguuugccucuaaaaucagaguuucauuuguaguaacuccaauuuagauguaagauaauuag

SEQ ID NO: 2242441 - RNA, 58 nt, Homo sapiens
uuuggaagcacauuguuuaauuaaggaggauacuguuuaauuuccauguguuuucaaa

SEQ ID NO: 2242442 - RNA, 86 nt, Homo sapiens
cauuagauucugauaaggagugugcaacuuagcucucuuacaugcucaguucacaguaggguuugcacuccuaugagaaucuaaug

SEQ ID NO: 2242443 - RNA, 61 nt, Homo sapiens
agaaaguuccaugcgcuguugaauagaauguguauucugugguuguugcauggaauguucu

SEQ ID NO: 2242444 - RNA, 62 nt, Homo sapiens
ccauucagaugccugagaacagcuaagcuccguaaaguugguucucuuagccaucuuaaugg

SEQ ID NO: 2242445 - RNA, 72 nt, Homo sapiens
cuaauuugguuauaguguaucuugaguaaaucaccucaaugagaauuuuagguuacauauaauccaaauuag

SEQ ID NO: 2242446 - RNA, 60 nt, Homo sapiens
ccucuugggcaaaacucaaccagggcuaacaaauaaggcuggauugagaaccccaggagg

SEQ ID NO: 2242447 - RNA, 92 nt, Homo sapiens
ucuguacuauucuugaauuugaucacuuaggaacgaauaugauuggaacucauucauguuuagagagggugucaaauugagaaccaggcaga

SEQ ID NO: 2242448 - RNA, 63 nt, Homo sapiens
ugugcaaucuuccauuuuuaggagguaguuuauuuaaaugacuuaaauugagaagauaguaca

SEQ ID NO: 2242449 - RNA, 64 nt, Homo sapiens
uuugaaucugaaacucugacauugucugugacuauuucgaaggcaaugugagaguuuauucaaa

SEQ ID NO: 2242450 - RNA, 93 nt, Homo sapiens
ucaaaauaauguuaaaagccaucucaaaggguuguuaugugaauuaaauacaauggcauggaacuacuuugaaacuuuuaacauacuguuuga

SEQ ID NO: 2242451 - RNA, 67 nt, Homo sapiens
accugagguuggguaauuuaugaagagaaaagauuuauuuggcucauaauuacgcuagcugaaaggu

SEQ ID NO: 2242452 - RNA, 62 nt, Homo sapiens
auugugguugacuaaauuuguaauucacagggagucucguugcagaagcagacgaccauaau

SEQ ID NO: 2242453 - RNA, 69 nt, Homo sapiens
ugcggugggugcgggaggcgcgccuaggugccgaaacccggucugugcugccauccuguggccauugca

SEQ ID NO: 2242454 - RNA, 119 nt, Homo sapiens
guuugcaguaucaauggacucuuuuuuuucacaaagguuuuucuguagcauguaaugcuguuugauagcaauuuaucacaguagaacucuuuccaaaauuggagucaguucucucaaac

SEQ ID NO: 2242455 - RNA, 56 nt, Homo sapiens
cccaaaggauucauuuccaggagucugaaaagauucuggaauuuggauauuuuggg

SEQ ID NO: 2242456 - RNA, 109 nt, Homo sapiens
gacauuugcuccccuauggagaaaccaggauaacagggcuguggguauggaccagaggccugggggaaguacucaguagucuguugcugucuccacugaagcagauguu

SEQ ID NO: 2242457 - RNA, 107 nt, Homo sapiens
guccacaccucuugagagcucaucuuuuccuccaccauggugaccaagagcaccacccaugcccugccaucaaaguggagggaaggaccaaucucgggccccuggau

SEQ ID NO: 2242458 - RNA, 60 nt, Homo sapiens
uugacaaggagugggguugagaaaagauuaggaguuuaguucugaaccuuguccuugcaa

SEQ ID NO: 2242459 - RNA, 65 nt, Homo sapiens
ugagauuugggaggggccaggggcagaauuauaugguuaggcuuuguguccccacccaaaucuca

SEQ ID NO: 2242460 - RNA, 62 nt, Homo sapiens
uucugaaucccauuucucuguguuuuuuaggaagggaaaaagggcagaggaaggggguggaa

SEQ ID NO: 2242461 - RNA, 99 nt, Homo sapiens
ugcacucauccauccacuuagucacacacucaacuuuucaucuugggugauggagguugggaugcuugugauuuuggugaggauagagauugagaugca

SEQ ID NO: 2242462 - RNA, 129 nt, Homo sapiens
gcaugcaccgcacuuaguaaggggcauguggucucagaaauugaaugguaacucaugaaguaguauacaguguuguuacugcauaauuccugggaagauacauccccuauacuguuagauuuuucaugc

SEQ ID NO: 2242463 - RNA, 81 nt, Homo sapiens
gauggugggcacuagauauuauuugacuccauguuaccguguuaccagcauggagaugaauaucaucuguugccugccauc

SEQ ID NO: 2242464 - RNA, 57 nt, Homo sapiens
gaggcacauagauggaauuaugggaauggaaacaaaucauauguaucuuugugccuc

SEQ ID NO: 2242465 - RNA, 69 nt, Homo sapiens
gucaauaucugugauuuggaugaguuguaauuguuuuaauauugcauaucuucagccgggcacgguggc

SEQ ID NO: 2242466 - RNA, 62 nt, Homo sapiens
gggaagugggagggagacaucaagaauuauggcuuuaguucaucuucucccaucccuuucuc

SEQ ID NO: 2242467 - RNA, 88 nt, Homo sapiens
ggagucucgcucuguugccuaggcuggagugcaguggcacgaauucggcucacugcaaccuccaccucccagguucaagcaauucucc

SEQ ID NO: 2242468 - RNA, 68 nt, Homo sapiens
uuuaagauuguuauguggugaauuauauugauuuauuuucaaauguuaaaccagauugcauucuugga

SEQ ID NO: 2242469 - RNA, 64 nt, Homo sapiens
aaacugcugguugcuggccagccaauguauuaauuguccuuggucaaaugccaaucuguaguuu

SEQ ID NO: 2242470 - RNA, 64 nt, Homo sapiens
ugacaaauucuaugcccauucaagacuggaacucacagucacuaaagggcaggaauuaauguca

SEQ ID NO: 2242471 - RNA, 97 nt, Homo sapiens
gggccauguuggcaauaguugaucugugugauuggaugcauuuucaaagaguuuguuaauggugccuuucugcauagacaguguuccacaaucgccu

SEQ ID NO: 2242472 - RNA, 72 nt, Homo sapiens
ugcucuuuucuauagcuuacuuuucuuuaaaaguuggucuuuaugagguagagugguuuauuuggaagagca

SEQ ID NO: 2242473 - RNA, 70 nt, Homo sapiens
gagcccugaaagcuacagucuccuaggacccugaaggcuccuaaaccuuugagcuuuugucagaggguuu

SEQ ID NO: 2242474 - RNA, 55 nt, Homo sapiens
uucgguucauaaccacguguaaaauggaaacagcaaugagguguaugacacugaa

SEQ ID NO: 2242475 - RNA, 61 nt, Homo sapiens
ugagguaagaguuuuccauuucugaaggacugcuaacagagaaaguaaagauucuaccuca

SEQ ID NO: 2242476 - RNA, 87 nt, Homo sapiens
gaguaacacaugaggauggugccugcugacauaguuacauuuauugagcacuuaugcacuaggcacuguguuugcauguaaugacuc

SEQ ID NO: 2242477 - RNA, 68 nt, Homo sapiens
gaccacugugagacugguucugaacccagugaccuccaucucugggagcaguugcaucuccagugguc

SEQ ID NO: 2242478 - RNA, 69 nt, Homo sapiens
acacaguaaauauugucuccucugugaucauaauagugaugaaaaugauggugacagugaugcugaugu

SEQ ID NO: 2242479 - RNA, 56 nt, Homo sapiens
gucuuguugaaggcuuaaaaaaggucuuaccucccuuuuuuccccuuucuuaagac

SEQ ID NO: 2242480 - RNA, 74 nt, Homo sapiens
gcucacggcuauuaucccaacacuuuggggguggguggacugcuuaaucucaggaguuugggaccagccugagc

SEQ ID NO: 2242481 - RNA, 57 nt, Homo sapiens
cugucuggcuggcuggcuggcuggauggauggacagauagacagcuagauuagauag

SEQ ID NO: 2242482 - RNA, 67 nt, Homo sapiens
guuuuuggaagaugccacuguaucaguuauaauuucuuuugcuagauacuuauaaucuuccaagagc

SEQ ID NO: 2242483 - RNA, 66 nt, Homo sapiens
cacaguuauuccuauacuggauuuuaggucucugaagaacugcugguguuuaggaauaagaaugug

SEQ ID NO: 2242484 - RNA, 76 nt, Homo sapiens
ccagagucugguguucucacacuaguuggcacauagcugaagcuccuauuauguguguggauacacagagagcugg

SEQ ID NO: 2242485 - RNA, 58 nt, Homo sapiens
acccaggauggagugcagugacgcaaucacagcucacugcauccuugaccuucugggu

SEQ ID NO: 2242486 - RNA, 62 nt, Homo sapiens
uaacaacucuuugguucugugcagccuauggacagcuuaugggcaggaauuaggggguguua

SEQ ID NO: 2242487 - RNA, 97 nt, Homo sapiens
uugggaaagguccuugauuucugagaccaaaacuuguaacugagcuuuagauuauaaaugcucucaagaguguucaagugaguaaccccuuucucaa

SEQ ID NO: 2242488 - RNA, 68 nt, Homo sapiens
gauaguggucuuuuuaguuuagucaugaauuuguuagagaaaaaaugacuuuucugaaaaccaccauc

SEQ ID NO: 2242489 - RNA, 66 nt, Homo sapiens
guuggugcugccagagauucagaggugccauacacuugucaaaucuggaucauucguagugccagc

SEQ ID NO: 2242490 - RNA, 71 nt, Homo sapiens
cuuagaucuuguaggacagagacuauacagaaaagagacauuugaauagugacuuugauucugcuucugag

SEQ ID NO: 2242491 - RNA, 55 nt, Homo sapiens
uugagauggagucucgcucuguggcccaggccagagugcaguggcaccaucucaa

SEQ ID NO: 2242492 - RNA, 60 nt, Homo sapiens
uucucacggcccugcgcacuggcauuuuccaccuguaaugcguggcaggagccgugggga

SEQ ID NO: 2242493 - RNA, 64 nt, Homo sapiens
guugugaauagugccgcaauaaacaugcgugugcaugugucuuuauagcagcacgauuuauaau

SEQ ID NO: 2242494 - RNA, 64 nt, Homo sapiens
guaaucucaccuacuugggaggcugaggcgggagaaucgcuugaacccaggagguggagauugc

SEQ ID NO: 2242495 - RNA, 73 nt, Homo sapiens
ggugguggggucguaggugcccgccagguaguagagguccugccgguccuggcacuugcggcuccgggccauc

SEQ ID NO: 2242496 - RNA, 55 nt, Homo sapiens
cagugcuuugguucucaaagcuucuuuucaaugggugcuuagagacaaaacauug

SEQ ID NO: 2242497 - RNA, 85 nt, Homo sapiens
ggauuaucugagaucacuuggucauacugcuuugaaaacugggaaacuccucaaagugcuauggcucagguucagggaaggaucc

SEQ ID NO: 2242498 - RNA, 58 nt, Homo sapiens
uuaaggggaccugugagaguacaggugaaccaagcaucagauucuacaggccuuuuga

SEQ ID NO: 2242499 - RNA, 120 nt, Homo sapiens
uauuuuagagacagggucucacucuguugccuaggcuggauugcaguggugcuaucauagcucacugcagccuccagcuccugggcucaagugauccucccaccuuggccuccuaaagug

SEQ ID NO: 2242500 - RNA, 56 nt, Homo sapiens
uugaagguauauucuguuaaugcuuuauccaggugggcaauuaacauauaccucaa

SEQ ID NO: 2242501 - RNA, 101 nt, Homo sapiens
uguuuuuauguuuuauguuuuuuacguuaacuuaaaaguauuuaacagacguuacuccuuccuguauagagguagguuaauuggaaaacaaauugaaaaca

SEQ ID NO: 2242502 - RNA, 56 nt, Homo sapiens
ggaucauguacaacggugacacgugccaaucucauugcaugguagucacaugauuc

SEQ ID NO: 2242503 - RNA, 99 nt, Homo sapiens
cugucaaguccagugggggauuaugggcauuuguuaacuaacuacaugaauauauaguguggcagaugcucuuggugcccauccacaugccuuuggcag

SEQ ID NO: 2242504 - RNA, 71 nt, Homo sapiens
cguguugccuaggcuggagugcagugguaugaucucagcucacugcaaccuccgccucccagguucaagcg

SEQ ID NO: 2242505 - RNA, 64 nt, Homo sapiens
aaggaguacccauggguguugagaacauugauucuucuaaacaucccaugccuggguacuccuu

SEQ ID NO: 2242506 - RNA, 57 nt, Homo sapiens
aggcuucaccauguuggccaggcuggucuccaacuccugaucacaggugagcugccu

SEQ ID NO: 2242507 - RNA, 58 nt, Homo sapiens
auuguuuuccaaagaugcugcuuccucugcaguuuugcagguuguuuuuggauacaau

SEQ ID NO: 2242508 - RNA, 77 nt, Homo sapiens
ugagaauaaaauugcaaugcgaggcagagguagugaaccuuuauuuuccucugcguuuuguuagcagcaaguuguca

SEQ ID NO: 2242509 - RNA, 86 nt, Homo sapiens
ugggagaagcaugguuuccaggggucacucauucacucauuacuucccugggcaugggaggauccuuuggcucuguguugcuccca

SEQ ID NO: 2242510 - RNA, 58 nt, Homo sapiens
gaccuuuaguccguucuacuuuuccugaagauggaggacuguaagggauauaaagguu

SEQ ID NO: 2242511 - RNA, 65 nt, Homo sapiens
gaagcugccugcaucagucgcuacuccuaggacaggugcugcccuugauugaccagagcaguuuu

SEQ ID NO: 2242512 - RNA, 111 nt, Homo sapiens
cuucccucuggcauuauaacugucugauuuguguauucuguauuauacuucccacucaguagaauguauacaguauacaguaacagaugguauuugaagucauggaugaag

SEQ ID NO: 2242513 - RNA, 75 nt, Homo sapiens
cgcuccuggaugacagcaucugugaaguugugcacuaugucacaggcccugcagaagcgucgcccauugggagug

SEQ ID NO: 2242514 - RNA, 61 nt, Homo sapiens
guaauagaucauugucauuuuagauguuuuaagcaaucaauguguuauaaugauuuguuac

SEQ ID NO: 2242515 - RNA, 107 nt, Homo sapiens
gaguagaaggcauaauucacuaggucauacuguuaaaugguuuaguuuuugaaacaagauuacaauugagccuuaacagcauggauuugagcugcacaggucuacuu

SEQ ID NO: 2242516 - RNA, 61 nt, Homo sapiens
ugcaagcacacccagggauuguugguagacaguguguuuguaccuggggacugugugugca

SEQ ID NO: 2242517 - RNA, 65 nt, Homo sapiens
auaccaucacuagaggaagcugcuuccuucagagcacagugcuuuuguuccucuccuggugguau

SEQ ID NO: 2242518 - RNA, 73 nt, Homo sapiens
ggcugcaaauggcaguuuggucucugugcugugaagaaucaauggaaagggcccagcugccaugagagaagcc

SEQ ID NO: 2242519 - RNA, 103 nt, Homo sapiens
aucaugugguuuuugucuuuggcuguguuuauaugcuggauuacauuuauugauuugcauauauugaaccagccuugcaucccagggaugaagcccacuugau

SEQ ID NO: 2242520 - RNA, 68 nt, Homo sapiens
ccuucccacccgcccagguguggccgggacagcaccgcaguuguggcgccccugggugggcaggaggg

SEQ ID NO: 2242521 - RNA, 114 nt, Homo sapiens
acaccugcugguuuuuuuuuucaaaggaagagcauugaguuaaugguucaauguuaaugugaguugauuuuauugauuuugugcuggaaguugauuaauuauaaugguaggugu

SEQ ID NO: 2242522 - RNA, 79 nt, Homo sapiens
ugcuuuaaguuccaggguacauguguacaacaugcagauuuguuacauagguauacaugugccauguugguuugcugca

SEQ ID NO: 2242523 - RNA, 82 nt, Homo sapiens
gguaucuuuauagcagcaccucacucuacugguaccaauuuacuguauuagucuguucucaugcugcuaauaaagacauacc

SEQ ID NO: 2242524 - RNA, 63 nt, Homo sapiens
ugacuacagauuugcugccagaauggauacgaaagaauuccauuggccaggugcuguggcuca

SEQ ID NO: 2242525 - RNA, 65 nt, Homo sapiens
caccagcacauuaguaucuaagaacaugaaaguucagcauaugucuuuuaccuaaugagcuggug

SEQ ID NO: 2242526 - RNA, 118 nt, Homo sapiens
uuagaaacuuuaaaaaauuuauaauuuagugagcauaaaaugguaguuuuaagucuauaguucuuuuaaguauuagcuaauugugcuuauuugauaauuucauuguuggagccuuuga

SEQ ID NO: 2242527 - RNA, 56 nt, Homo sapiens
guguuuccucuuguuauugauuucuacuuuuauguaaucguggccugaggagauac

SEQ ID NO: 2242528 - RNA, 67 nt, Homo sapiens
uagguauuacauguccaacucccaauuccccuccaaacuagaccauggauagggcaugugaagccua

SEQ ID NO: 2242529 - RNA, 66 nt, Homo sapiens
auuguaccuggugagacauguuuuauaguuccucuuaacccuauagcacugaccuuccaggacaau

SEQ ID NO: 2242530 - RNA, 56 nt, Homo sapiens
uuauaugauugaagugcauaagacauacuuuuagguuuuggcacugagugguauaa

SEQ ID NO: 2242531 - RNA, 58 nt, Homo sapiens
gcuggcaaaugguuauaaggccaauuggagugauuuuggaaaaauaaucuuugucagu

SEQ ID NO: 2242532 - RNA, 81 nt, Homo sapiens
gcugacuuuucauguucugucugguucuaagauucccaucuccgggauuucauugguagcucauggaaccgaaaagauagu

SEQ ID NO: 2242533 - RNA, 107 nt, Homo sapiens
ccaacuuuauuagucuuuuucauggucauuuuggcaacguuggaucccucaaauuaacauaugaguuuuaggaucagcuugucaguuuuugcuaagaaacaaguugg

SEQ ID NO: 2242534 - RNA, 98 nt, Homo sapiens
uuauuuuacuucagugaaucagagugaugguuuaaguauugcacaagggcacuucaugugaugcaugccacacuuuggauucugcaugggagagauaa

SEQ ID NO: 2242535 - RNA, 65 nt, Homo sapiens
cuuuuucccuuugaauuggaaagguguuuuuuagacaccuuggagucuagugcagaggaaaaaag

SEQ ID NO: 2242536 - RNA, 70 nt, Homo sapiens
acguguuuaacaaccagcagacagaaacccuaacuuguagaacuugccgcuuucugugguguaaauacgu

SEQ ID NO: 2242537 - RNA, 74 nt, Homo sapiens
acuuugggaggcugagacuggaggauuaagugagccaugauugugcuacugcacuccagcuuaggagacaaggu

SEQ ID NO: 2242538 - RNA, 71 nt, Homo sapiens
ucuaagaauucauuuauaagccucaguaguaaaucuaugaaugcuguauggcuugcaugacuucaauuaga

SEQ ID NO: 2242539 - RNA, 88 nt, Homo sapiens
gggaccaugucuugguauuuuacauauaguugguacuucauaaaugcuuauugauuuuaauuguaucuauagaugucaagaacguucu

SEQ ID NO: 2242540 - RNA, 59 nt, Homo sapiens
aucagcagcgguggcugcagaacagcguauuuuggugaacugcaaaugcugcugcugau

SEQ ID NO: 2242541 - RNA, 73 nt, Homo sapiens
uuggggaaggcacugugugccacccugccucuccggggagaacagggcugguaacacgggccuggcucccuga

SEQ ID NO: 2242542 - RNA, 60 nt, Homo sapiens
gccaaucaggaggcuguacaucagggcgggggcgggaggagcugcagcuuugugauuggc

SEQ ID NO: 2242543 - RNA, 62 nt, Homo sapiens
uucacaguguuucucacgguuaggaugcugacuaaaccccagacugcaagcgaggcugugaa

SEQ ID NO: 2242544 - RNA, 77 nt, Homo sapiens
gagcugcuugcucuuccaugcuuuccuuaaaaaaugaguuuggcucuccuuuuugaguagcuggagagcagccccuu

SEQ ID NO: 2242545 - RNA, 59 nt, Homo sapiens
gggagggaagguaccugugugaccaugcauugugcuuuagccacagugcuuugcuuucc

SEQ ID NO: 2242546 - RNA, 64 nt, Homo sapiens
guuugcauagugcugggaggggaggggaaggcugaucgccccacccuaaucuuauugugcaaau

SEQ ID NO: 2242547 - RNA, 85 nt, Homo sapiens
uaauaauagaugcugaaguuucacagacaacuggucccuuacucaauagguaagaucaguucuuuugauuuucuaaauauuauug

SEQ ID NO: 2242548 - RNA, 82 nt, Homo sapiens
ucccagacacaagagauaccugcuguugcuauuugugaccaaauaccauauuugucaauaacuaccaacaggggcucuggga

SEQ ID NO: 2242549 - RNA, 56 nt, Homo sapiens
uuaugucacuguucagucucccucaaaacagugagcaggucugaguggugacgugg

SEQ ID NO: 2242550 - RNA, 56 nt, Homo sapiens
uucacagugugaucuaugggcaaugugcugcuacaccaccauguuucaccugugaa

SEQ ID NO: 2242551 - RNA, 62 nt, Homo sapiens
ugagaaugaugauuuccaguuucauccaugucccuacaaaggacaugaacucaucauuuuua

SEQ ID NO: 2242552 - RNA, 66 nt, Homo sapiens
ugcauuugaguccauucgaugcugauuccauaugaguccauccaaugaugauuccauucaugugca

SEQ ID NO: 2242553 - RNA, 91 nt, Homo sapiens
gucugaaaacuuuuggcaugaaguguguuuuaucucugugacuucuaacccuagaugguagcauauauuuagcaaauaaaccauuucagac

SEQ ID NO: 2242554 - RNA, 60 nt, Homo sapiens
aggugcuugagguaggaggagcuuggauuacugauuuaagaccuuccuuccuuccuaccu

SEQ ID NO: 2242555 - RNA, 78 nt, Homo sapiens
ccgguaugaggaaugaucauauguuucagguuaaauguagcaagcaguuugacuuuuagaauaugaguuuccagccgg

SEQ ID NO: 2242556 - RNA, 120 nt, Homo sapiens
uuuuuuuuuuuugagauggagucuuacuuugucacccaggcuggagugcagugagccaagauugcaccauugcacuccagccuggcaacaagagcgaaacuccaucucgggaaaaaaaaa

SEQ ID NO: 2242557 - RNA, 85 nt, Homo sapiens
guuuuaacccuguguuauguucuacuuuuaggugcuuggugaagcagcauuuacuuguuaagcagagcaugggacgguugauagc

SEQ ID NO: 2242558 - RNA, 70 nt, Homo sapiens
accuggggaggaucaugauuggcaucuuuaacauuuuuugaccagaucaauugcugauucgcucuauggu

SEQ ID NO: 2242559 - RNA, 70 nt, Homo sapiens
uauacugucuuuguaugccuagaagugcagcuaucucuuuguuaacacuaguuuuaugcaaggcaguaua

SEQ ID NO: 2242560 - RNA, 102 nt, Homo sapiens
uugagauggaguguaguuuuguugcccaaguuggggugcagugcuccaucuuggcuuacugcuaccuccagcuucuggguccaaguuauucuccugccucag

SEQ ID NO: 2242561 - RNA, 59 nt, Homo sapiens
gggcuaagaagagaaggggguagaccauaagcugauggccuccauuuguauucuugccc

SEQ ID NO: 2242562 - RNA, 79 nt, Homo sapiens
gagggucauggcacagacugagugaagauuugccgagaauauucuggaagaugggaccucaguuuugucucaaccacuc

SEQ ID NO: 2242563 - RNA, 56 nt, Homo sapiens
gugaaagcaucugacugugccaguucugauuuugguacauaaauggauguuuucau

SEQ ID NO: 2242564 - RNA, 97 nt, Homo sapiens
gaaauggaaauaaaauauuagggcaugugggaaguuauaauuuucaucuuauauguuuuuauaguuucuuagugucaugaacauguuuuaucauuuu

SEQ ID NO: 2242565 - RNA, 63 nt, Homo sapiens
aggaugaauauuuagugggauagauggauggauguccuugaccuacccgugaauguuuauucu

SEQ ID NO: 2242566 - RNA, 69 nt, Homo sapiens
agaguugucaaguaaauguuaugguuaucuagaaacugaauggccauuacauuuacaaaugucaauacu

SEQ ID NO: 2242567 - RNA, 75 nt, Homo sapiens
gguagaaauugucuuauuuaugugggcuagaguuacacgggaagucuaaucugugcauagaagaggcacucugcu

SEQ ID NO: 2242568 - RNA, 70 nt, Homo sapiens
caggaucagggagacuaaagagcuugcccugggagagagccacaguccaugaucuuuggucuacugccug

SEQ ID NO: 2242569 - RNA, 65 nt, Homo sapiens
auagccuuguaaguuuccaguccccuggagaacaaauucucuuaaaacuaggccuacaaagcuau

SEQ ID NO: 2242570 - RNA, 66 nt, Homo sapiens
uugaguauuggacugguaucuuugcgacuucacaaaacugugccgacucaucauuucaaugcuuaa

SEQ ID NO: 2242571 - RNA, 57 nt, Homo sapiens
guugcucucugguuucgcaggaaauagauuguucuaaucuuugaaaucagggucaau

SEQ ID NO: 2242572 - RNA, 63 nt, Homo sapiens
aguuugccaguauuuuauugagaauuuuugcaucgauguucaucagggauacuggcuuaaacu

SEQ ID NO: 2242573 - RNA, 61 nt, Homo sapiens
gaaagaaucaacuaugucucuggcaugcacaucaaugaugagaacaguguuguauuuuuuc

SEQ ID NO: 2242574 - RNA, 70 nt, Homo sapiens
aagucuuugcuauugugaacagugcugcaauaaacauacgugugcaugugucuuuacaguagaaggacuu

SEQ ID NO: 2242575 - RNA, 69 nt, Homo sapiens
auaggucaucaugggagugggacugcugguuuuacaagaagcuagucccuuccccaugugauguccugu

SEQ ID NO: 2242576 - RNA, 58 nt, Homo sapiens
gggguaugacuauggauugugaggcucuuuaagagguuaaaggcuccaauuauacccc

SEQ ID NO: 2242577 - RNA, 68 nt, Homo sapiens
uguggguuauuuauucaacugaagccagcacugguaacauggugauuaguaaacucaaugacaccaca

SEQ ID NO: 2242578 - RNA, 82 nt, Homo sapiens
aguuuuaggguacaagugcacaaugugcagguuuguuacauauguauacacgugccuuguugguguacugcacccauuaacu

SEQ ID NO: 2242579 - RNA, 113 nt, Homo sapiens
gucagauuagcagcacauuagauucucauaggagcacaaacuauugugagcugugcaugcaagagaucuagguugugugcuccuuaugaaaauauaaugccugaugaucuguc

SEQ ID NO: 2242580 - RNA, 78 nt, Homo sapiens
uagugagguuuuagaaaguagaaaagcugguugauaguguaaggaauuuuuaggccaauuuucuauuuuuuccuucua

SEQ ID NO: 2242581 - RNA, 78 nt, Homo sapiens
uauccacaagauggcugcugcaugucuacaguucucuucuuccugugaagauguaagcagcagagacuauccugggug

SEQ ID NO: 2242582 - RNA, 61 nt, Homo sapiens
uggagugaccauucuuugaaguuucauuguccauuucauuuccaggaaugguaauacuuca

SEQ ID NO: 2242583 - RNA, 66 nt, Homo sapiens
guugcagcacacaggcugucagcugaccaggcaucgaagggcagggacugcacugugugccguaac

SEQ ID NO: 2242584 - RNA, 55 nt, Homo sapiens
guuuuuucagguuucacucgcaguuuauuugcuggagugcaaauaaagagagggc

SEQ ID NO: 2242585 - RNA, 87 nt, Homo sapiens
cacugaguauauauguuuguuuagaugguaaaucaguauugagauauacuggacuuaaugaugaauuguauauacaaauauucagug

SEQ ID NO: 2242586 - RNA, 71 nt, Homo sapiens
gauucauguugacagaauuuacuuuacaaggaugauuuuccuuuguaguguuuauucugucaacagguauc

SEQ ID NO: 2242587 - RNA, 68 nt, Homo sapiens
uguuuuugucuggauucagacaugauuauggaaugaucuugucauggucuugauccauuauggaaaca

SEQ ID NO: 2242588 - RNA, 59 nt, Homo sapiens
ucucugauuaaacaagauagugaauuucaugaaacacuaaauuuguuuagaaucagaga

SEQ ID NO: 2242589 - RNA, 58 nt, Homo sapiens
ugagcugagaucacacuacuguacuccagccuggaggucagagugagacuucgucucg

SEQ ID NO: 2242590 - RNA, 69 nt, Homo sapiens
gcugguuuauuguuauuuauauccacagacacaaaaucuguacccuccagugauaacaguggacuaugc

SEQ ID NO: 2242591 - RNA, 61 nt, Homo sapiens
ccuguuuuauagauggaaaguaagcuuggguaauuuaagcucauuuccauucuacaacagg

SEQ ID NO: 2242592 - RNA, 59 nt, Homo sapiens
guuugugaaccucuggccaagaugagggguuccucaucuccucuagaggcuucagagac

SEQ ID NO: 2242593 - RNA, 77 nt, Homo sapiens
gcuggcaaaugugguguuugagcugccagggaucaucagggucucucugcagcccgggacacugcauauauucuagc

SEQ ID NO: 2242594 - RNA, 76 nt, Homo sapiens
ucacuugaacccaggagguggagguugcaguaaguagagauugugccacugcacuccaccuugggcaacagaguga

SEQ ID NO: 2242595 - RNA, 64 nt, Homo sapiens
ucaagugaucaaagugcuggaauuacaggcgugagccacugugcuggccuuuggugacuucuga

SEQ ID NO: 2242596 - RNA, 63 nt, Homo sapiens
gauggacugagaaagagaacagaaagaucuuaaaauauucugugacacuuccgucaguucauu

SEQ ID NO: 2242597 - RNA, 58 nt, Homo sapiens
uccccuuagucauguaacacuaguuuccauauggaaacuauuacagaguaauggugga

SEQ ID NO: 2242598 - RNA, 71 nt, Homo sapiens
uuucuuaaaagucauugaaaaauguauagcuagaguuaugucucuaugugcaaauuaauugcuagaagaaa

SEQ ID NO: 2242599 - RNA, 69 nt, Homo sapiens
uaggcaaguugcccaaucucucugagccuuguucuuccaucauuaguaaaaaagagaggguuuugccua

SEQ ID NO: 2242600 - RNA, 64 nt, Homo sapiens
guaaucucagcuucuugggaggaugaggcaugagaauugcuugaacccaagagguggagguugc

SEQ ID NO: 2242601 - RNA, 69 nt, Homo sapiens
guggcuuucaagugaccgucuuuugucauugaacuucaaguugacagugagaugucaugugaaaguuau

SEQ ID NO: 2242602 - RNA, 76 nt, Homo sapiens
guccucugauagaucugggcaaaguaaaucaaaaacuuucuggaaaagauuuaccauuuuagaugcuauuaaggac

SEQ ID NO: 2242603 - RNA, 66 nt, Homo sapiens
cacacugugaacggacugaagcccacuuaacuguucacucuaaagugguucaguucguuacgugug

SEQ ID NO: 2242604 - RNA, 57 nt, Homo sapiens
guaagugguagagcugggcuaugaauuuggauguuucuggcucacucauucacuuau

SEQ ID NO: 2242605 - RNA, 77 nt, Homo sapiens
cucugggcgauaaagagcuuuugaggugucaugggcuaugaaccugguacgaguucuuucugaucagccuguuagag

SEQ ID NO: 2242606 - RNA, 61 nt, Homo sapiens
ugagagauuuccaauaggaguaucagggccagcagaacccuucuugguuggaggucuuuua

SEQ ID NO: 2242607 - RNA, 65 nt, Homo sapiens
aaacaagacuagaaaucauuuguugagcacuuaaugcuuagcagucacuguucuaaguauuguuu

SEQ ID NO: 2242608 - RNA, 77 nt, Homo sapiens
ucaaguugaaaucucuacuauuuugaucuguauucucuuaaauauuaaagguuauaccuagggagauuccauguuga

SEQ ID NO: 2242609 - RNA, 130 nt, Homo sapiens
ucccuguauuugaaauucagaacucaagcuuggcucuaaguguuuccuugcuuugcugugcuccaggggagucacugagcagaaggaagcgaguugccugagauucuucaaagccugcagcccuuuugga

SEQ ID NO: 2242610 - RNA, 65 nt, Homo sapiens
guuuuaggguacaugugcacauugugcagguuaguuacauaugaguacaugugccaugcuggagc

SEQ ID NO: 2242611 - RNA, 63 nt, Homo sapiens
caucugcaaauacuugugggauuuuuagcacagcaaguggaaaaucuguccagguaucagaug

SEQ ID NO: 2242612 - RNA, 69 nt, Homo sapiens
ucuuuauagcagugugaaaauggacuaauacaauaaauuuguaccaggaguggggcacugcuauaaaga

SEQ ID NO: 2242613 - RNA, 112 nt, Homo sapiens
gaggccucuguucuguuucauuggucuauaugucuguuuugguaccaguaccaagcuguuuugguuacuauagacuuguaguauaguuugaagucagguagugugaugccuc

SEQ ID NO: 2242614 - RNA, 58 nt, Homo sapiens
cauggaauguggaaugguaaguagaggucgaggucagauggcuacccgcauggccaug

SEQ ID NO: 2242615 - RNA, 74 nt, Homo sapiens
gagguuaugauuuguuucaggaguuuucuaggaguugagguucccaucagaaaacucagaggccaauagaccuu

SEQ ID NO: 2242616 - RNA, 84 nt, Homo sapiens
caucgaggauccaugguauggcaguuucagcuauaguuuuugcucagggauuuauuguuggaauucuauccuggaucuauguug

SEQ ID NO: 2242617 - RNA, 57 nt, Homo sapiens
uuugaggaccagugcuaguuugcucaccgcauuuugaguagcacugugucuuacaaa

SEQ ID NO: 2242618 - RNA, 63 nt, Homo sapiens
ugggaguugggcagaacaaguggcuugaguguguccuggacuuguuuguccugcccuuucuca

SEQ ID NO: 2242619 - RNA, 105 nt, Homo sapiens
uugaccacuguugugauaaaguuggaaauuggaaacauuuaugguaacaguaugcucaugagggcuuuuuuguucuuaauguuuucacuuuuaaucagugcucaa

SEQ ID NO: 2242620 - RNA, 102 nt, Homo sapiens
uguuacuggaaggcccauaaaaagggcuguuucuugacuuggugggucugagugggccagggucggguuaagaugcuagccucguggggugccauccugaca

SEQ ID NO: 2242621 - RNA, 59 nt, Homo sapiens
auaucacagguguuuaccugaucuugccuacaucauuucauuguaauuaucugugguau

SEQ ID NO: 2242622 - RNA, 79 nt, Homo sapiens
gcguggcaaugugugagcuaagcaaauaugagccaucauacuggcucugcugcacccuuggcuccucacacaugucugc

SEQ ID NO: 2242623 - RNA, 105 nt, Homo sapiens
ggaggaggaggugaaaguggaggagaaagaagcauuucucuagcaguacugugcuugguucugaaguggcaguguuuucauuucuuucauuccauuuccaccucc

SEQ ID NO: 2242624 - RNA, 127 nt, Homo sapiens
gcuauuaacuuuucauuccuuugucaacugcaagaaucguaguauuugacaaguuggguuuuucuugucaaauauuaccauucuugcaguugacaaaggaaugaaaguuuuuuuuuuuuucaguagc

SEQ ID NO: 2242625 - RNA, 69 nt, Homo sapiens
uacagucauaaugccuagugacagagauacguucugagaaaugcaucacuaggugauuuugucauugug

SEQ ID NO: 2242626 - RNA, 58 nt, Homo sapiens
gagaaugaugguuucguuucauccaugucccuacaaaggacaugaacucaucauuuuu

SEQ ID NO: 2242627 - RNA, 84 nt, Homo sapiens
gucuggggggucaugacagugcugucugcuuuggcuaggggccacuccguggcuuucugcagcagcugcuggggccccccaagc

SEQ ID NO: 2242628 - RNA, 61 nt, Homo sapiens
guggggguguaggcaguggugggaggagauuuggcaccuacuacccuguccccaccuuuac

SEQ ID NO: 2242629 - RNA, 94 nt, Homo sapiens
ugcuuagcguguacaucuugguucuucuugcuauuucuaucaucuucaauguauuaaaagcuguuugagguguaaggacaacagagacuaagua

SEQ ID NO: 2242630 - RNA, 79 nt, Homo sapiens
caggcaaucuuccuaaauuucuuccucugugagauaguauaucauuucacugaggucugagcuuuaugaauggguccug

SEQ ID NO: 2242631 - RNA, 85 nt, Homo sapiens
gccuccccuggacacugagaucuuggaggcuuugugauccagccuuggaugccggguccugagaucuugcaguccagggaaaggu

SEQ ID NO: 2242632 - RNA, 68 nt, Homo sapiens
gauuaaguguaaugucugaaguuugagacagauauuucuacugugaauucucugauauuuacuuaauu

SEQ ID NO: 2242633 - RNA, 127 nt, Homo sapiens
uauugaauuauuuuccagcuauauauaaaaagagaaaaggauauaugggugugugcaugcauauauauaucacauauauguaucugcacauacacuuauagcauauauagagaauaaaaguucaaua

SEQ ID NO: 2242634 - RNA, 63 nt, Homo sapiens
gagguaagaugauucguguccuuaugaaugaaugcugauauuaagggaugaauuaguuaucuu

SEQ ID NO: 2242635 - RNA, 73 nt, Homo sapiens
ucacuguggauggaacuaugugagaaaggagauauaggaaaauauccauuacaaggauucuguucauggauga

SEQ ID NO: 2242636 - RNA, 130 nt, Homo sapiens
uuccuuuauaaauuccccagucucagggacguucuuuauagcagugugaaaacggacuaauacaguuaauugguaccaggauuuggauacugcuauaaagauaccugaaaauguggaagugacuuuggaa

SEQ ID NO: 2242637 - RNA, 63 nt, Homo sapiens
ccauguguccauguguucucauuguucagcucccacuuauaagugagaacaugugguauuugg

SEQ ID NO: 2242638 - RNA, 62 nt, Homo sapiens
ugcuugugagcgaaugugugucuuguuuucagccacugaguucauggucauuugucacagca

SEQ ID NO: 2242639 - RNA, 62 nt, Homo sapiens
uugacagaccuuggucauauccucugacucaccaucuucucugugacccucagguuugucaa

SEQ ID NO: 2242640 - RNA, 60 nt, Homo sapiens
uuggcaaguccccaccucucucuuucaguccauguguugggggaggucagggcuggccaa

SEQ ID NO: 2242641 - RNA, 84 nt, Homo sapiens
aaguuaaugggugcagcacaccaacauggcacauguacauauacguaacaaaccugcacguugugcacauguacccuagaacuu

SEQ ID NO: 2242642 - RNA, 82 nt, Homo sapiens
aacccacuagagagcucugaaguuauagaaccacagcagcaguguguuucuauggucacagaugcuugauuauuagaggguu

SEQ ID NO: 2242643 - RNA, 96 nt, Homo sapiens
uguuuagugcucggcucuuaguugagaucaaguauucuccacuaagaggaaucaauucuuuggagaaauggcugaucaaaaagcugagacuagaca

SEQ ID NO: 2242644 - RNA, 101 nt, Homo sapiens
guguaaauauuugucuuuuggucuuuugcuagccagagagcucuugucagagauauuagcucugcuuucuaagcagaaguuucuguaggcagagacugcac

SEQ ID NO: 2242645 - RNA, 61 nt, Homo sapiens
ucuuuugugauucuucaguuacuucaggccaucuggauguauaugugcaggucacaggaga

SEQ ID NO: 2242646 - RNA, 121 nt, Homo sapiens
ccccuaauaucacaguggguguacacccugugauguuauuccuuauaucccaagaagauauuauuauaacuaauaucacaguggguguacacccuaugauauuaucuguuauauacugggg

SEQ ID NO: 2242647 - RNA, 57 nt, Homo sapiens
gcuuggagaugggggaugagccugaagggguaugguucaacccuugcgucaccaagc

SEQ ID NO: 2242648 - RNA, 93 nt, Homo sapiens
ucacacuaucacacccaggcuagagugcagguguaugguuacagcucacuguugauugcacaccugcacucaagccaugaugugacagaguga

SEQ ID NO: 2242649 - RNA, 56 nt, Homo sapiens
ggauauguagggcauaucuacauacuaaaauauguagcacuaugcacuacacaucu

SEQ ID NO: 2242650 - RNA, 82 nt, Homo sapiens
gcugaucacgaccccggccgguagucgggaauggcggccuccguggucacccugacaugcggccgaacccucgagacgcggc

SEQ ID NO: 2242651 - RNA, 83 nt, Homo sapiens
cucccaugacccaggauuccaguuugugagaagcugugccaugugcaaugguuaacauuccagauuggagccugacacgggag

SEQ ID NO: 2242652 - RNA, 90 nt, Homo sapiens
gcagaucuugguuugcagauggaucauucuugccguauacucacauggcaagaaagaaaucaucugucuuaucucuagacucgaguuugc

SEQ ID NO: 2242653 - RNA, 72 nt, Homo sapiens
ggagcacacaacuuggauuccucauaugcacaggucacaauacgguuugugcuccugugagaaucuaguucc

SEQ ID NO: 2242654 - RNA, 58 nt, Homo sapiens
aacuucugccuggacauccaguuguuucuauacauccugugaaaucuaggcagagguu

SEQ ID NO: 2242655 - RNA, 70 nt, Homo sapiens
gagaucagauaguuguagauaugcagcauuauuucugagggcuguguucuguuacaaugaucuauaucuc

SEQ ID NO: 2242656 - RNA, 55 nt, Homo sapiens
cgcugugguauuauuagaaauauccaagggagauauuacuucuaauaucacagug

SEQ ID NO: 2242657 - RNA, 93 nt, Homo sapiens
gcgauucuacuguuuggaggggaguaaagccugcuuuuaaugcgcagcagaaugaaccagggcuuugguucaaccaggcaauuggaaggucgc

SEQ ID NO: 2242658 - RNA, 58 nt, Homo sapiens
ccucagcuccuauaucuguauggccuguuuuuuccuagguuaugauuguagagcgagg

SEQ ID NO: 2242659 - RNA, 101 nt, Homo sapiens
ugagucaggagaaucacuugaacacaggagguggagguugcagugagcugagauggcgccacugcacuucaaccucauugacagagcaagacuccaucuca

SEQ ID NO: 2242660 - RNA, 78 nt, Homo sapiens
ggccaggauuugcaauuuaaugugucccaauuaauucacuugaaaauuaguaacacucuguuuacguugccucuggcu

SEQ ID NO: 2242661 - RNA, 70 nt, Homo sapiens
cccugcagagucuguccugccugcccacuccuucagccaagguuccggcacaucgcagacuuugucuggg

SEQ ID NO: 2242662 - RNA, 73 nt, Homo sapiens
cuuguuacauuuucacugacucaagggccauugccaacagccuagccaucuggucaggagaaugguaacugag

SEQ ID NO: 2242663 - RNA, 61 nt, Homo sapiens
ccaagucuauguguucucauuguucaacucccacuuaagagugagaacaugugguauuugg

SEQ ID NO: 2242664 - RNA, 82 nt, Homo sapiens
uucaaguccuaguagaaucccuugcaaugucccuccucccuggaaggcaagaggagauucugcucccagaacaggccuugga

SEQ ID NO: 2242665 - RNA, 58 nt, Homo sapiens
aauuuauuucuaugcuagggacaaaugggauaauuucauuugguguuagaaauaaauu

SEQ ID NO: 2242666 - RNA, 90 nt, Homo sapiens
aaggcugauugaauggacguagauucucaaggauuuccucucuucuaagugugaccuuuaaaagcaauuuaccucuuucaguucagucuu

SEQ ID NO: 2242667 - RNA, 106 nt, Homo sapiens
gaagacauguaaagaaauaagaaagugugaccaauacuugggaggaaaaagcaguaaauagaaacuuuugaguaggcuuauauuuugguuuuauuagauagacuuc

SEQ ID NO: 2242668 - RNA, 109 nt, Homo sapiens
ggccuccuccccacucaugccccgaaugacugucagggcagucauugcagugaagccaugcaggaaugcccgacggcucaugaagggggccacgaacaggacagaggcc

SEQ ID NO: 2242669 - RNA, 69 nt, Homo sapiens
augcuggugguucacaugcgcagacacacuggcgagaagccacacaagugcacggugaggcaccagugu

SEQ ID NO: 2242670 - RNA, 60 nt, Homo sapiens
uccucagcuccuaucucuguauggccuggcuuuuccuagguuaugauuauagagcgagga

SEQ ID NO: 2242671 - RNA, 73 nt, Homo sapiens
cgguguccuggagugucagaaacaguguccuggcugggugcaggaccuguaaucccagcacuuugggaggcug

SEQ ID NO: 2242672 - RNA, 60 nt, Homo sapiens
cugagcuuguuuucccauaacuagauggucccaucugggggugaugggaaacagugacag

SEQ ID NO: 2242673 - RNA, 75 nt, Homo sapiens
ugaacuucaauaacgccauucucucaccuugcauuuucaaacuuaaaggaggaaauggcuucuuauugugguuca

SEQ ID NO: 2242674 - RNA, 70 nt, Homo sapiens
uggcugugacaguuucucaggcuuccuuauuuuugaugaccuugacaguuugaggaauauuggucagcua

SEQ ID NO: 2242675 - RNA, 57 nt, Homo sapiens
ugagauguaaucucgcucugucacgagacuggagugcaguggcgcgaucucaucuca

SEQ ID NO: 2242676 - RNA, 61 nt, Homo sapiens
aaggcaccauaggcaaauccaggaugcucuccuuaugcccugauuguucuugcugggccuu

SEQ ID NO: 2242677 - RNA, 100 nt, Homo sapiens
aauacaugcuugcuaugacauaauugugaugauugaaauacugugugugacaugacuagcacagugcuuggcacacaguaauaacauagcugccaguauu

SEQ ID NO: 2242678 - RNA, 108 nt, Homo sapiens
aggacccaugaggauaagcugcaggcugugagguuucuauaguacacuccuuccuggaaugacucugccuaaauuucaccuuuaagccucagagauucauguuaucuu

SEQ ID NO: 2242679 - RNA, 75 nt, Homo sapiens
ugguuauuuccuaaguaggcaacuauaaagugugcacauacacauacuagaaauugcauacuucucagaugauua

SEQ ID NO: 2242680 - RNA, 59 nt, Homo sapiens
agccuugaacuccugggcucaagugcuccuugugccuuggccuccuugugucuagggcu

SEQ ID NO: 2242681 - RNA, 55 nt, Homo sapiens
gcuuccaaucauggugaaaggcaaguggggagccagagucucacaugguggaagc

SEQ ID NO: 2242682 - RNA, 67 nt, Homo sapiens
uuugcuguuuggaggauucauuaaugaaauaaaguauaaugacaauaagacugccccagacagcaag

SEQ ID NO: 2242683 - RNA, 61 nt, Homo sapiens
gaagcaguguggacuaaugggaagagacacaacauauucuucuccaguuucucauaguuuc

SEQ ID NO: 2242684 - RNA, 108 nt, Homo sapiens
cuucuagaugaaacugaguugugucucuccuggaagcacguguuugugguugagguguaauagguaggugguuuuaggcagagacaucuuuaguauuguauauaggag

SEQ ID NO: 2242685 - RNA, 63 nt, Homo sapiens
guucaguuuuaaagggaaauugcuauuuuaguucuuaugcuauuuuuauguguaaaacugagc

SEQ ID NO: 2242686 - RNA, 62 nt, Homo sapiens
uauucauguuuuccugcauaucaguucuuuuauauugcuguguguauaucacugcaugagug

SEQ ID NO: 2242687 - RNA, 128 nt, Homo sapiens
guuauuaaauauuucuugucuaagcuaagucgacaaaguuucuucuaacaucuggaauuuuuaauaucugagacuguuuuggggaacuucauuguauucuucugccgacaaguaaaaaaaagaauaau

SEQ ID NO: 2242688 - RNA, 126 nt, Homo sapiens
aaaugcaaauaauaauacuuucuucauaugauugauguggaggguaaauauaguagaacauguaaagccuuuagaauaauaccugccacauuugaaucaugcaguaagugucaaauauuaguauuu

SEQ ID NO: 2242689 - RNA, 62 nt, Homo sapiens
gccuuuaaggaacuugcacugugauaacauaugguagaaaauugcaaguugccuuuggaggc

SEQ ID NO: 2242690 - RNA, 76 nt, Homo sapiens
uugcuugaacccaggaggcggagguugcagugagccaagaucgugccacugcacuccacccuuggcagcagagcga

SEQ ID NO: 2242691 - RNA, 56 nt, Homo sapiens
augagggaagcucacguguccaccuggcaauugguaggagcaucugguuuccccau

SEQ ID NO: 2242692 - RNA, 62 nt, Homo sapiens
ggugauuagagcccaagcuuugaauucacacagaccugaauucuaauccuggcucugucacc

SEQ ID NO: 2242693 - RNA, 86 nt, Homo sapiens
gaggaaauagaugagagguaacacuguucagugggcacuuuuguacuagguccaguguuggagguuuuaccaucauuauuucacuu

SEQ ID NO: 2242694 - RNA, 87 nt, Homo sapiens
ggagaaucacuugaaccugggaggcggauguggcagugagccgagaucacgccacugcacuccagccuugcgacagagugagacucc

SEQ ID NO: 2242695 - RNA, 102 nt, Homo sapiens
uugaggcagagucgugcucugucaccuagacuggagugcaguggugcgaucuuggcucucugcaaccucugcgucugggauucaagcauucuccugccucag

SEQ ID NO: 2242696 - RNA, 106 nt, Homo sapiens
gaugugaaauucugaacaagagcuuguguuugucugccuggggagagcucaugugcccuuugcuuuuccaggagcauauacaacgcagcuguuugguacuaucauc

SEQ ID NO: 2242697 - RNA, 87 nt, Homo sapiens
gauaaacaggaaugcuuuuacacuguugaugggaguguaaauuaguucaaccauugcagaagacaguguggcgauuccucaagaauc

SEQ ID NO: 2242698 - RNA, 88 nt, Homo sapiens
guccugcacauagagaacuggcuucaccauucugcacagguagacaaugcagagugauggcaguauuucaguagugacaucccaggac

SEQ ID NO: 2242699 - RNA, 71 nt, Homo sapiens
gaagucaugguuauguguuuccuuaauugcuuuuauuuauagcagccauuguaugacauaaacuggacuuc

SEQ ID NO: 2242700 - RNA, 71 nt, Homo sapiens
cagaaauuuaucuucucacagucuggagucuggaacauccaggaucaaggugcugacaggauagguuucug

SEQ ID NO: 2242701 - RNA, 67 nt, Homo sapiens
cccaguuaggcuuuucagacacuucauuuugcaaauaaguguuuuuuaaagggcuuugugggcuggg

SEQ ID NO: 2242702 - RNA, 121 nt, Homo sapiens
uauuauauaucccugaaaucuaaaguggauaacacauguggagagagaaugacuuaucugauuaaaagaaugaugucauuuuaauuucuaaucaauguguugguuacuaggauguauagua

SEQ ID NO: 2242703 - RNA, 66 nt, Homo sapiens
uagcaucuacuccaugagauuguugaaguagccaaagcucuuagaauagugucuggauccaagcua

SEQ ID NO: 2242704 - RNA, 72 nt, Homo sapiens
gcgaugauuaggauaugcugugucugagagccugacauguguuucuuccuuucaguaguuguauccuguugc

SEQ ID NO: 2242705 - RNA, 69 nt, Homo sapiens
gucagcucuuguuaaaacuaacuagccuggauacaaccucugguguuuguuuguuuuaucaugagugau

SEQ ID NO: 2242706 - RNA, 81 nt, Homo sapiens
uuacaugauuaucucagugaacugaguggaugcugaaguuuuuccaaugcuuuuuccacauucacugagauaaucauguaa

SEQ ID NO: 2242707 - RNA, 56 nt, Homo sapiens
gugauuguucuguccccaggggcuacuuagccuggccuugugggcacgaacagcau

SEQ ID NO: 2242708 - RNA, 63 nt, Homo sapiens
uaguucuagggcaucaucccagacauuauuuugagaaucucuguggugaggcccuagaaucug

SEQ ID NO: 2242709 - RNA, 62 nt, Homo sapiens
uuuauagcagugaguauugacuaauacagaaaauugguaucagaaaugggcauugcuauaaa

SEQ ID NO: 2242710 - RNA, 115 nt, Homo sapiens
cuucagauauacgaguuucuaccacucauuggucauuucuuaacuagagugaacaaaauuguuggcuuuuuaaggaaauugccugucugguggguaaagcguaucuauuuguaag

SEQ ID NO: 2242711 - RNA, 71 nt, Homo sapiens
gucaacucugguuagaaacagguccucaggaguauucucuaaccugauauuuucuaaaaagauauguugau

SEQ ID NO: 2242712 - RNA, 57 nt, Homo sapiens
ucuuuaucuaauguuuggccauuaagaaauccaaguggguguuccauuggauaaaga

SEQ ID NO: 2242713 - RNA, 55 nt, Homo sapiens
gcaauuuccaagcucuaucccauuugguuuuccccccauggugcuugaaaguugc

SEQ ID NO: 2242714 - RNA, 78 nt, Homo sapiens
gucacccaggcuggaguucaguggugugaucuuggcucacuacaaccuuacaaccucugccucccaaguucaagugau

SEQ ID NO: 2242715 - RNA, 62 nt, Homo sapiens
uuuuggcuuuuccucagcaagcuugcccuuagugacaggauugcagaagagagaagcuagaa

SEQ ID NO: 2242716 - RNA, 61 nt, Homo sapiens
uugagauauccauaaaugggaagccaggugagcaagccuucuuuccagaaugguguuuuaa

SEQ ID NO: 2242717 - RNA, 55 nt, Homo sapiens
ugacccaccuauuauuuuuaaaaugugauuguuuuggaaacaccuggugagguua

SEQ ID NO: 2242718 - RNA, 75 nt, Homo sapiens
gccgugcgcucugcgggggagcugccgggcgccccuuguccagugcuugcagcucagcugcggaguuuuguuggc

SEQ ID NO: 2242719 - RNA, 60 nt, Homo sapiens
gaacuucugccuggauauccugguguuuccacacaucuucugauaucuagggggagguuc

SEQ ID NO: 2242720 - RNA, 90 nt, Homo sapiens
caucccuucaggucuccaaggaaugcuaaguuuccucccugucgugagagacacgaggugaacuuaguguugggagacagaagcuggaug

SEQ ID NO: 2242721 - RNA, 78 nt, Homo sapiens
uuucugaaagcucuuuuaucagacaugugacuaugguuuuugccgaguagcacaaugugugugauugaaugucagagg

SEQ ID NO: 2242722 - RNA, 73 nt, Homo sapiens
guagucaccgagggcucgggucagguccucgcccacaugcuccgggcuuccuggcacugggccccguggcugc

SEQ ID NO: 2242723 - RNA, 72 nt, Homo sapiens
uuuaccaggcugggacaauuucuaaacacaguaaucauauuaaucauggcaagauuguuccgguuugguaga

SEQ ID NO: 2242724 - RNA, 90 nt, Homo sapiens
gcacagaggggaaggggggcaccugcaugcccggcugggucucuguagacaguggaucaugcgaggccuccccucuccuugacccugugu

SEQ ID NO: 2242725 - RNA, 57 nt, Homo sapiens
aucaugggggcaguuucuaaugguuuagcaccaucccccuaguacuguucucaugau

SEQ ID NO: 2242726 - RNA, 70 nt, Homo sapiens
aagucuuugcuauugugaauagugccgcgauaaacauacgugugcauaugucuuuauagcagcaugauuu

SEQ ID NO: 2242727 - RNA, 72 nt, Homo sapiens
caaccacuguuuaaauggcugaggaugucagaucuagcccuugcucuuugccaaaauuugcugcagugguug

SEQ ID NO: 2242728 - RNA, 59 nt, Homo sapiens
aggaagacauauagaacuaaaaagccauggggaacuugaagaguucuguauuucugccu

SEQ ID NO: 2242729 - RNA, 97 nt, Homo sapiens
caacgcuaaaauaccaaggauauuauugguugcaaauuaaucucucaguuaucacauaaugggcacugauguauucuguguguguuuuaaaacguug

SEQ ID NO: 2242730 - RNA, 98 nt, Homo sapiens
aagaggguuagaaacauaucucagaguguacaagauuacgaauuguuuggaaugauuuuuagcuauucugaagauguguggacuuaacauagccccuu

SEQ ID NO: 2242731 - RNA, 82 nt, Homo sapiens
aguuccuucaggguaagaaccaugaaguaaauguacaaaauguugguacauguauccauuguuuuugguuuuccagggggcu

SEQ ID NO: 2242732 - RNA, 65 nt, Homo sapiens
agcggagagauggaauauugguggccaucuuuagggacuaucuaccacauuccuucuuuccuguu

SEQ ID NO: 2242733 - RNA, 62 nt, Homo sapiens
ggucauacccuguaaucugaaacaugaaccaauuuauggcuuaaauacuacagggcaagauu

SEQ ID NO: 2242734 - RNA, 110 nt, Homo sapiens
agcugcacugaagguauuggcuggacuaugguucuaugauucugaucuagagcuugggguucucucucagguuuacucaggucauuggaagaauucaguuccuugcagcu

SEQ ID NO: 2242735 - RNA, 68 nt, Homo sapiens
acacacugcccaguggacagaaagucaucauucuugagugaugcuguaucucaugcaugggcgugugu

SEQ ID NO: 2242736 - RNA, 64 nt, Homo sapiens
guuucugagcaugagcucauuucuacccuucuuugucugugacgugaguuccuuguucagaagc

SEQ ID NO: 2242737 - RNA, 56 nt, Homo sapiens
ugugccuacugauagagccaagggcugauauccuaucuggcucugucgaaggcaca

SEQ ID NO: 2242738 - RNA, 66 nt, Homo sapiens
gggugacagaguaagacccuguaucauuauuauuuuauuuugaaacagagucccacucugucgccc

SEQ ID NO: 2242739 - RNA, 61 nt, Homo sapiens
uuacauuccuggggguauuaugacugccucugcugccucauacaggccaccagggaaguga

SEQ ID NO: 2242740 - RNA, 102 nt, Homo sapiens
ugagauggaguuucauucuuguugccuaggcuggagugcaguggcgcgaucucagcucacuacaaccuccaccuuacgcauucaagcgauucuccugccuca

SEQ ID NO: 2242741 - RNA, 62 nt, Homo sapiens
uuuaaucuuuucugcuggaagaugcaagaauaauuuuaugcagucauuuggaaaagguugaa

SEQ ID NO: 2242742 - RNA, 62 nt, Homo sapiens
acagacgcagcugagagcuccugaagcuccugaaaccucugaggagcauucucuugcuuugu

SEQ ID NO: 2242743 - RNA, 97 nt, Homo sapiens
aguggauuauguaaaaacauaguuuuacugggaaaguacaggucacagaugccccugugucuuguuuuuucccaggcaaaacaaacauaguuucacu

SEQ ID NO: 2242744 - RNA, 63 nt, Homo sapiens
guggaguacugagggucacuuauuuauuuauuuauuuauugaaacggagccucagucugucac

SEQ ID NO: 2242745 - RNA, 95 nt, Homo sapiens
ucagaucaucaggcauuagacucucauaagaagcacgcaaccuggaucccuugcaugugcaugucuaugcgagucuaaugcuucaggugacguga

SEQ ID NO: 2242746 - RNA, 79 nt, Homo sapiens
aaggaauugcuuaucccacugcauagcuggcuugaucugcuagugauaacaggaaugcaauggaaaggacaauuaccuu

SEQ ID NO: 2242747 - RNA, 58 nt, Homo sapiens
ucuacucuaccuucugccucuauggauuugccuauuugagguaccucauguaagugga

SEQ ID NO: 2242748 - RNA, 96 nt, Homo sapiens
agacggagucucacucugucacuaggcuggagugcaguggcgugaucucggcucacugcaaccucugccucccggguucaagcgauucuccugucu

SEQ ID NO: 2242749 - RNA, 60 nt, Homo sapiens
ugaguuauuuauucuguggcuucaguuagguugugagucaugguaguaaauuuggacuca

SEQ ID NO: 2242750 - RNA, 74 nt, Homo sapiens
ggggcguggagucaucacucagaguggauuccuagacagaaaaaggugcaugccacugaggagaguucaccccc

SEQ ID NO: 2242751 - RNA, 60 nt, Homo sapiens
ggcuuccccucccuuggcucagugaugguaugugagggcugggcaaguaugugggaaguc

SEQ ID NO: 2242752 - RNA, 75 nt, Homo sapiens
agguguguagugguaucucauuguuuuauugccaauucccugaugacacauaauguugaguaucuuuacacaucu

SEQ ID NO: 2242753 - RNA, 67 nt, Homo sapiens
auuguguguugcugauauuugggguacagaugaucuuaucaccuagguaguuagcauacuacacaau

SEQ ID NO: 2242754 - RNA, 62 nt, Homo sapiens
aggccuuggccuuuagguaaagcuuaaagaacucucuuuaguaauuucuguaaggcaggccu

SEQ ID NO: 2242755 - RNA, 61 nt, Homo sapiens
gggagguagauuguauuaugacaaauaauauuuaggguuguuauagcaauuuuuuucuccu

SEQ ID NO: 2242756 - RNA, 74 nt, Homo sapiens
uuccagcaaguuggaguuaagcaguaaugaauugcacagacaauucauuuaagaaguuuagcaguugcuaggag

SEQ ID NO: 2242757 - RNA, 77 nt, Homo sapiens
agggagauguaccaugcacccguagugcuuucaauuauaguguugugagugagggugcugugggucagacauucccu

SEQ ID NO: 2242758 - RNA, 57 nt, Homo sapiens
caugguguauaugugccaaugggugcagcacaccaacauggcacauguauacauaug

SEQ ID NO: 2242759 - RNA, 82 nt, Homo sapiens
aguuuuaggguacaugugcacaacgugcaaguuuguuacauauguauacgugugccauguuggugugcugcacccauuaacu

SEQ ID NO: 2242760 - RNA, 128 nt, Homo sapiens
ggaggagaaaaaaacagccuaaagauucuucucuuaauucugacaacaguggcguuugagcaaggcagcgccaugggucagauugggcagaacaucccaggcuccuuuucccuguauuugucuuuucc

SEQ ID NO: 2242761 - RNA, 66 nt, Homo sapiens
uguggcaguuuuaaauaugaaaacacccccuguauguauuggguguauuuauauuuaaacucuaua

SEQ ID NO: 2242762 - RNA, 57 nt, Homo sapiens
cuaucucauugguuuuugaaaguuuugggaugggcauuucaaaauaccaagagauag

SEQ ID NO: 2242763 - RNA, 83 nt, Homo sapiens
aacuggacccaucacaggccucagugggaaacuccagaacaguucugccauucuccacauggugugcugugaguggucuaguu

SEQ ID NO: 2242764 - RNA, 70 nt, Homo sapiens
ucugguuguugucggcaucuuuccaaaacacuguauuagcuguugcaguggaauguugccagcagccaga

SEQ ID NO: 2242765 - RNA, 67 nt, Homo sapiens
auaugguacuuaugcucaaacuagaaacaucuaccagacguaaccucuuugaagguagguacuauau

SEQ ID NO: 2242766 - RNA, 58 nt, Homo sapiens
gcagucaugugaggagcccagacaggaccagcaaagucuggcucagucaacugacugu

SEQ ID NO: 2242767 - RNA, 85 nt, Homo sapiens
gugauuaugacauguauuuccaggauuuuagcauuucaaauagaaugugcauuuuuaaauacugaaauauacggucauccaucac

SEQ ID NO: 2242768 - RNA, 92 nt, Homo sapiens
ggguuggauuuaaacaagcugcauuuucuagaugcuuaugaugaaugaagagguaagcaaggaaguuguagcuguggguaagaaaacgauuu

SEQ ID NO: 2242769 - RNA, 66 nt, Homo sapiens
ugcuugagcuggggggauggaggcugcaaugagcuauaauugcaccacugcacuccagcuugggca

SEQ ID NO: 2242770 - RNA, 79 nt, Homo sapiens
uuugaacaaguuuuccuuuauugaguaccaacccauguaaugguaaccuggacuuuaauaaaagggaaaugaguuugaa

SEQ ID NO: 2242771 - RNA, 90 nt, Homo sapiens
uuucagguaucuucauagcaaugcucuacuucccaguaccaauuuucuguauuagucuguucuugcacugcuaugaagaacuaccugaga

SEQ ID NO: 2242772 - RNA, 78 nt, Homo sapiens
gggauauauuaagagcucauccauaguugucacugauuugagacagugacaacuauggaugagcucucaauauauucu

SEQ ID NO: 2242773 - RNA, 83 nt, Homo sapiens
aauuaucacaugugauagguugucacugucacuguugcuacugcccugguucaaagucacaggcaucucucacuuggauaauu

SEQ ID NO: 2242774 - RNA, 64 nt, Homo sapiens
gaauuucaaguaagaaagacaucaggugcaaaggcccuguggcuggggcuugcuugguggguuc

SEQ ID NO: 2242775 - RNA, 73 nt, Homo sapiens
ugagagcucucauuguauugaaaaagaagaggcucugacugucuuguucuccuaagaugaaugcaaguacuca

SEQ ID NO: 2242776 - RNA, 81 nt, Homo sapiens
gucacaguucacacuuugcgcuguauucccuuguuagacucaagaucucaacagugggcacuguaaauguggaauggugac

SEQ ID NO: 2242777 - RNA, 69 nt, Homo sapiens
aggccauuggaaaagugcaguauuugggcaggagugucccauuuuuccagguacugucugucauggcuu

SEQ ID NO: 2242778 - RNA, 76 nt, Homo sapiens
ucugaaaaacuucuccuguaaauaucucucauacugguugccaucugagacauacuuacaggggaugcuuuacaga

SEQ ID NO: 2242779 - RNA, 61 nt, Homo sapiens
acugaguguugauuuagauuaacuuguugauaauuucuagaugggucagucaggacucagu

SEQ ID NO: 2242780 - RNA, 71 nt, Homo sapiens
ugggaaugaucacugugccuccugugaugugaaggaauuucuuggucauauugggccagucaguuaucuca

SEQ ID NO: 2242781 - RNA, 58 nt, Homo sapiens
guuuccuugaugguguugcccuucauaaagaugagcccuaagacgaucaucaggaggc

SEQ ID NO: 2242782 - RNA, 96 nt, Homo sapiens
ucugaguuuacaagugcuguuuccuugagaaaguacaaggcuguauuuuucuucacauauagcugcauuucagugaaauauuucuuggccuucaga

SEQ ID NO: 2242783 - RNA, 60 nt, Homo sapiens
cucaaagugcugaaagaggccaggugcaguggcucacgccuguaaucccagcacuuuggg

SEQ ID NO: 2242784 - RNA, 103 nt, Homo sapiens
accaauaaauugagggcuaggaaagcuguguugugcccagcaucauagacagcacugucuauguguggaauuauaacaggcccaagaucucuaagugauuggu

SEQ ID NO: 2242785 - RNA, 74 nt, Homo sapiens
agcuccuggauucacugauuuuuugaaggguuuuuugugucucuauuuccuucaguucugcacugaucuuaguu

SEQ ID NO: 2242786 - RNA, 84 nt, Homo sapiens
agaaucaucccauaucuaugaaaucggaaucucuuggguggaugccagagauccucauuuuauagacacucucaaggugauucu

SEQ ID NO: 2242787 - RNA, 62 nt, Homo sapiens
uaucuccacucucuuuugccucucucucucucucagauagguagguagauagaugauagaua

SEQ ID NO: 2242788 - RNA, 59 nt, Homo sapiens
gagaaugcuugucuguuauuuuaagccaccggguuugugguaaucugugacagcagcuc

SEQ ID NO: 2242789 - RNA, 63 nt, Homo sapiens
uuauugcagagccugcuuuguaagaccugcuuacuaccuugcagcacaguagguuugcaauaa

SEQ ID NO: 2242790 - RNA, 85 nt, Homo sapiens
gggggucccaggggcuggaggccugccugguuagccucuguuucccagacauugacucgaggcgccuccaguccucucaaccccc

SEQ ID NO: 2242791 - RNA, 58 nt, Homo sapiens
auacccucugggugguuaguugcaaccuuuucuuggacagcacuaaaucugaggguau

SEQ ID NO: 2242792 - RNA, 105 nt, Homo sapiens
ugguaacucuugaauauuugucagguaauugcuaagugcaagggaguaugggaaaagauuacauucuacucugugguguauuugcauugacauaaauaguagcca

SEQ ID NO: 2242793 - RNA, 58 nt, Homo sapiens
cacuaauuagugauaaggccaagacuaaaagguaggugucauaugucucugauuagug

SEQ ID NO: 2242794 - RNA, 56 nt, Homo sapiens
ggcccucugccuuuucaugugggauggcugccuuccacuagugagggcaaagggcc

SEQ ID NO: 2242795 - RNA, 99 nt, Homo sapiens
gaggcaagagaaucacuugaaccugggaggcggaguuugcagugagccgagaucgcgccauugcacuccagccuaggcagcaaagugagacuccaucuc

SEQ ID NO: 2242796 - RNA, 82 nt, Homo sapiens
ucuauugugcuauggccugaauguuuguguccccaaaaaauacauacacugaagacuaaccaccaaggugauagcauuaaga

SEQ ID NO: 2242797 - RNA, 58 nt, Homo sapiens
uaaguauuuuaauuccuggcauuaaggucaugugugccugggaugcuuuaaauauuug

SEQ ID NO: 2242798 - RNA, 66 nt, Homo sapiens
ugacaaagggcaguggcucgcuaacacuaacaugaauuuaaggcccagcaucauugcaauuuguca

SEQ ID NO: 2242799 - RNA, 73 nt, Homo sapiens
ccagacuaagaagcccuuuuuacuuuuuacuucuguuucaguaaguauuaagacuaagaggcuuguggucugg

SEQ ID NO: 2242800 - RNA, 76 nt, Homo sapiens
ccagccccggaaaucugggagucuuggcucugcugaugacugcaaggcaagcucaggccucaggugucggggcugg

SEQ ID NO: 2242801 - RNA, 65 nt, Homo sapiens
auuuagagggaagagcaguguguugagaagaauuagguucaacagaacugggcuugcuuuuggau

SEQ ID NO: 2242802 - RNA, 101 nt, Homo sapiens
gugguaaaauaugcauaacauggaguuugucauuuaaccauuuuuaaguauacaguucaauggcauuaaguacguuugcauuguugugcaaccaacaccac

SEQ ID NO: 2242803 - RNA, 130 nt, Homo sapiens
gagacuuggaaaaguaguucaaauaugcagccuaacagauaaagaugguuucauuuggcuguuagucuauugagauaauuuacuuguugaggaauguuuauuuaauguuuccauaaaaaauugaagucuc

SEQ ID NO: 2242804 - RNA, 58 nt, Homo sapiens
uguggcaaacucagcaugccccagaaauucacccuucuugcaggcccaguuugccaca

SEQ ID NO: 2242805 - RNA, 83 nt, Homo sapiens
ucuuagcucuuuuacugucuucagucccucugcuucaccucuugaguguguagugggauucaggcagauaagagggcgaaagg

SEQ ID NO: 2242806 - RNA, 65 nt, Homo sapiens
agagcacagcaccaaggugcagaccagcauguccacagagccaucggccaccuggugcguguucu

SEQ ID NO: 2242807 - RNA, 114 nt, Homo sapiens
uggaacaacuuguacuaggucggugcaaauguaauugugguuuuugccauuauuuuuaauuacuuuuaauggcaaaaaaacgcaauuacguuugcaccaaccuaacacauucua

SEQ ID NO: 2242808 - RNA, 64 nt, Homo sapiens
uuggugaauggcugcauccugucuuugccagcugaagauaauuaagagaucaguaauucaucaa

SEQ ID NO: 2242809 - RNA, 117 nt, Homo sapiens
cucacuaauacauugauuuuuguaguagucucguucuuuuaaaauccgucaucaucaauauggcucauuaggaaaaagaggcuggcaaggaaauuuuucuuaaauguugaaagugag

SEQ ID NO: 2242810 - RNA, 58 nt, Homo sapiens
gagaauuucacugagagaauuuuauuuacauaaaagaaaugucuuagugaaauugcuu

SEQ ID NO: 2242811 - RNA, 62 nt, Homo sapiens
gcugaaauguuuaauuugggaguaaacaucaacuuuaaagcaaccagguaaaauauuuuagu

SEQ ID NO: 2242812 - RNA, 84 nt, Homo sapiens
gaaacaaaggauuauuggaacauugcacaguaacaucuaagcaaagggaauguuacagugacuaauguuuuauguaccaguuuc

SEQ ID NO: 2242813 - RNA, 89 nt, Homo sapiens
gcccucugccucuggaccccugccuuggcccuaguucauggcuccucucuguuggacugggauggccgaggcuauagcccaggcggggc

SEQ ID NO: 2242814 - RNA, 55 nt, Homo sapiens
gugugauggcgcacacagggugugauggcgugcaccuguagucccagccacacac

SEQ ID NO: 2242815 - RNA, 120 nt, Homo sapiens
auagcagaauugugcuuacaauaagcauguacaguauaguaauaggauuugggugacuaaauuuaccauuuugcugucauugccaaugcuuuugguugugaaaauuuauaaaauugcuau

SEQ ID NO: 2242816 - RNA, 76 nt, Homo sapiens
guacuuauucuuaaccuugaaguuauauggccuuccugaauguaagggccuauucaggguggagaguaugaggugc

SEQ ID NO: 2242817 - RNA, 92 nt, Homo sapiens
ucuuuaacuucagcacuugaugauaugaguagucgcauugaugaucuggaaaagaauaucgcggaccucaugacacaggcugggguggaaga

SEQ ID NO: 2242818 - RNA, 62 nt, Homo sapiens
uuagccuccaaaauuguagaucagcuguuuucaaccucaacacuauugacauuuggggcuag

SEQ ID NO: 2242819 - RNA, 59 nt, Homo sapiens
uguguuauuugguuauuguaauugggauuuuucccauugcauuuaucaaauauuuaaca

SEQ ID NO: 2242820 - RNA, 61 nt, Homo sapiens
uacugguuuuggugggcagguggggagaaagaaagguuuaauaagcccaaaaaaaguagua

SEQ ID NO: 2242821 - RNA, 64 nt, Homo sapiens
uucaguuugccaguauuuuacugaggauuuucgcauugauguucaucagggauauuggccugaa

SEQ ID NO: 2242822 - RNA, 64 nt, Homo sapiens
uucaguuugccaguauuuuauugaggauuuucgcaucgauguucaucagggauauuggccugaa

SEQ ID NO: 2242823 - RNA, 88 nt, Homo sapiens
ggcucuccgcuuucuccaggcauaaucuugucuacauggaagaucaucccugagcaaugagcugccugcugaggggguguggugaguu

SEQ ID NO: 2242824 - RNA, 74 nt, Homo sapiens
cuaugguaagagaaaugcaugcaugucaucaccaaagugagaacugccuguauuuaucuauguuacgcaaaugg

SEQ ID NO: 2242825 - RNA, 67 nt, Homo sapiens
caaaauuugagauguuccaaugacuauuaucuucuuaacuugauguaguugaaagaacaucuuuuug

SEQ ID NO: 2242826 - RNA, 60 nt, Homo sapiens
uguguuauuuugcugggaaugaugguuuccaacuucaucugugucccugcaaagaacaua

SEQ ID NO: 2242827 - RNA, 64 nt, Homo sapiens
uggacugcagugcagcuguuaggcugaaauuaaacuugugagccuggagaaaagcugcaguuca

SEQ ID NO: 2242828 - RNA, 59 nt, Homo sapiens
ugucagauaaagaacuggaaagucuacucuuguaggcugacagugguuauacuuagaca

SEQ ID NO: 2242829 - RNA, 92 nt, Homo sapiens
cccucagagacuggauuuaagggacauguguugccuaagucccaucuucaaaaugacccagcagugacacuguuccuuuuuacucuguaggg

SEQ ID NO: 2242830 - RNA, 56 nt, Homo sapiens
agacaccauuucaguacuagguugcuuaguaguaauacaaguugcagauggugucu

SEQ ID NO: 2242831 - RNA, 75 nt, Homo sapiens
uucaguacuagauggcaccuuaaacacagguuugccucuauucuagcaaacaaucagagugcugucuguccugag

SEQ ID NO: 2242832 - RNA, 60 nt, Homo sapiens
ugauaggacuuuagcuucuacucauguuauaugggaauuuugaguagaggaguucuauca

SEQ ID NO: 2242833 - RNA, 71 nt, Homo sapiens
gcuugaaccugggaggcagagguuguggugagccaagguugcaccacugcacuccacccuggcaacagagc

SEQ ID NO: 2242834 - RNA, 99 nt, Homo sapiens
guccuuauuuucauguuuuagagauugugucucauucugucaccccaauuggaguguagcagugugaucacagcuuacugcacccuugaauuucuggac

SEQ ID NO: 2242835 - RNA, 57 nt, Homo sapiens
ugugcuauuuuugcauauguguguguauauccacgcacauguacacauguaugcaca

SEQ ID NO: 2242836 - RNA, 56 nt, Homo sapiens
gaugauagcuuucagauuauauaguuuuuguuaaauauugucuuagaguugucauu

SEQ ID NO: 2242837 - RNA, 64 nt, Homo sapiens
gucaucugugguauagauguggaugucuuuguucaaaugguccuugagucuuugcucagaugau

SEQ ID NO: 2242838 - RNA, 109 nt, Homo sapiens
cugguccugccuggagccugucuacagugauaggugauagguuugugcaguguguucauugcugcaaacaggcaucugugggggcagccugcagggaggauugaaccag

SEQ ID NO: 2242839 - RNA, 98 nt, Homo sapiens
uaguuggauuacugucacucauccauacuuacuguuaucaugcuuucucuuggugcuagauagcaggagaauggucaugggcauuugcggaucagcua

SEQ ID NO: 2242840 - RNA, 88 nt, Homo sapiens
ggagacuugcuugaacccaguggguggagguugcagugagccgagaucgugccauugcacuccagccugggugacagagcgagacucc

SEQ ID NO: 2242841 - RNA, 101 nt, Homo sapiens
uacccugugcacaaauacaguuuccagaugaaaugguaaucuaaacaacagagcuauacauuacuagaacauuuagggaacuguauggugauucuggggua

SEQ ID NO: 2242842 - RNA, 82 nt, Homo sapiens
auguaaguaguuuauauucaaugauuaguaucaguuggccaagccagucugugcuugauuauaugagugugugugugugcgu

SEQ ID NO: 2242843 - RNA, 88 nt, Homo sapiens
gccugugcgcauguguggguuugugugagugcccauguaugcacacguguauaugcauguacccacacaggcccaucuccucacaggc

SEQ ID NO: 2242844 - RNA, 117 nt, Homo sapiens
uuguuuaaaauuguguuuuagcaugucuuggucuuacuuuguccucuuacugucugcucuccuccauuagccaugugcaaaguuaagaucccaggaucugcuaccuuucaguuacga

SEQ ID NO: 2242845 - RNA, 78 nt, Homo sapiens
gcuuaggagaaagcuuagggaaaagucuuucaucauugagagugcuguuagcccuggguuuuucacagaugccuaggc

SEQ ID NO: 2242846 - RNA, 72 nt, Homo sapiens
gaagaugugugcugaucgggcacggugucucacccuguaaugagacaccuucacuuaauggcaggcaccuuc

SEQ ID NO: 2242847 - RNA, 94 nt, Homo sapiens
gaugcuccugccaggagcaauggcucaugccugcaaucccaacacuuugggauguaaaagugggcacauugcuugagcccaggaguucaagauc

SEQ ID NO: 2242848 - RNA, 73 nt, Homo sapiens
uuggguuuugauacaugucuaaucagacugauuucugucacauauagaaauuuagauacuguauuaaaccuag

SEQ ID NO: 2242849 - RNA, 58 nt, Homo sapiens
ucacugugugucucuguaucugaaucucuuuucccuggucuuacaaagacaccaguga

SEQ ID NO: 2242850 - RNA, 114 nt, Homo sapiens
auuacaauaggauauuuagagguaaaggaggcaagcuuauguucuuuaucuaauuucacaugccaacagauugcuauuuauggauugucuccuugugccauuuccuauuguggu

SEQ ID NO: 2242851 - RNA, 71 nt, Homo sapiens
gguuucugcgugucucuuccugucaggguuugccacuagccaggcuuuggcccugagggauggcauaaacu

SEQ ID NO: 2242852 - RNA, 68 nt, Homo sapiens
cuuugcuuuuggguagugaguuccuccaggcccuaggugggucuagagguauuauccaggagccagag

SEQ ID NO: 2242853 - RNA, 108 nt, Homo sapiens
augaagagaaacaagaauuuuagcaaauugaacauugcugcagugccuagaacaaugccuggcauguaguagauguugaauaaauacuuguuuaaugaacaacuuuau

SEQ ID NO: 2242854 - RNA, 55 nt, Homo sapiens
uugucacauggggcggcugcccucugccagugagggcaaagggccagugugacag

SEQ ID NO: 2242855 - RNA, 100 nt, Homo sapiens
cuauuuuaucauaacaaaaguuaaugguucaacuauggcauuuagagcugcccacguagccugauugucuauuuaguucacuuuugacugaguaaaaugg

SEQ ID NO: 2242856 - RNA, 58 nt, Homo sapiens
ugagacugagucucgcucuauugcccaggcuggagugcaauggugcaaucucggcuca

SEQ ID NO: 2242857 - RNA, 69 nt, Homo sapiens
guaaagaucauucagggaaggcugagagucauucuaagguuuagccuuugcuuuggugauuaauuuuac

SEQ ID NO: 2242858 - RNA, 85 nt, Homo sapiens
uggcauugccugccugagaaaauggagggcaacaggaugccaacacucagugccccguuuugucaggcagcuuuucugcaugcca

SEQ ID NO: 2242859 - RNA, 61 nt, Homo sapiens
uuaaggugaaguucucagaugcuggccaaccuaugaguuuugucuuagaauuucacuuuga

SEQ ID NO: 2242860 - RNA, 96 nt, Homo sapiens
aacaccaguuaguucuuuuacaucuuaagauugccuuaauuagauaaugguauuuuaguuauggaguaauuuuaagcaguuuuaaauagcuguguu

SEQ ID NO: 2242861 - RNA, 89 nt, Homo sapiens
guagcuuccagagauuucucacauuuagcaucaugacaacucagcaucaugaggcauggcuacugcagauguagggucucuguggcugc

SEQ ID NO: 2242862 - RNA, 65 nt, Homo sapiens
auguugagugcguaucagugcauuguggcauugaguguguaucagugcauuguggcauucagcau

SEQ ID NO: 2242863 - RNA, 69 nt, Homo sapiens
uuuuuguaaauuuaaguuccuuguagagucuggauauuagaccuuuguaagaugcauagauugcaaaaa

SEQ ID NO: 2242864 - RNA, 87 nt, Homo sapiens
caauuuuguuuauguuugugcuauguuauauauucuguuuguuuaaaacuaggguuuaugugauggguacauauggacauaaaguug

SEQ ID NO: 2242865 - RNA, 73 nt, Homo sapiens
uaauuuugauguguugggaagauuucaaguccucucuccuggcuauuuugaaauacaccauacauuguuguua

SEQ ID NO: 2242866 - RNA, 71 nt, Homo sapiens
gcugcugacgaugaauauuuaacgcugugagcagaugcucacaguauggggggugguuauaaaauagcagc

SEQ ID NO: 2242867 - RNA, 77 nt, Homo sapiens
gaguuaucaauaaguaguaaagcagugacuaguaaauaauuggcaagugcuuuaucuacauuaucuuauaugaacuc

SEQ ID NO: 2242868 - RNA, 58 nt, Homo sapiens
agauaaugaucacccacagugucuaaugggaaucagcuauucugugaugaucuugucu

SEQ ID NO: 2242869 - RNA, 64 nt, Homo sapiens
ggaaccauggggcagcuagguggcaccuaggcugcagcccugaucaccuguagcugcauguucu

SEQ ID NO: 2242870 - RNA, 66 nt, Homo sapiens
uucuauuaagucacugagacuuguggcugcugguucucagcauuauuauaaucagugacugaagaa

SEQ ID NO: 2242871 - RNA, 116 nt, Homo sapiens
acaagggcgaauuauauuagguuuuuacaaccauuguaagggcuuuggcuuuucucugcaugaaauucaaagauguuauaaaguuuuaaauacagaugugaugugauuggacuugu

SEQ ID NO: 2242872 - RNA, 129 nt, Homo sapiens
aggaaugauagguguaugccaccggaaauggacaauuuuuagauuucgcauagagauggagucaugcuauauugccuagccuggucucaaaauccuguccuuaauggauccucccgccucagccuuccu

SEQ ID NO: 2242873 - RNA, 55 nt, Homo sapiens
uggaugggccaagccacuugcuaauuaaaaauguuauaaaguggcuuguucacca

SEQ ID NO: 2242874 - RNA, 58 nt, Homo sapiens
ugagacggagucuugcucugucacccaggcuggagugugguggcaagaucuccgcuca

SEQ ID NO: 2242875 - RNA, 69 nt, Homo sapiens
cuucuugagggccugcugggaaguggagguagcccagaacugacaggcccagguucggcccucaaggag

SEQ ID NO: 2242876 - RNA, 62 nt, Homo sapiens
gggccugcuuaagugucaaggcaaucaauuucaccaaaguuuacacuggaguaucaaggccc

SEQ ID NO: 2242877 - RNA, 59 nt, Homo sapiens
ggaagcggugggcaugccauuggcacacaggaguggcgauggcuauucuuaccauuucu

SEQ ID NO: 2242878 - RNA, 60 nt, Homo sapiens
gucuacaaguauuuuuauuagugccugccacguguuggcauuguucaaaaugcuugggau

SEQ ID NO: 2242879 - RNA, 90 nt, Homo sapiens
cuuucucccuucacuuaggacuuuucuugagagugacuguaucagcuauggccacucucaacaaagagaucucaggaccagguuagaaag

SEQ ID NO: 2242880 - RNA, 116 nt, Homo sapiens
cagccaagugcucagcacauaaagugcuuacuaaguugccaacuuaauagacuccuauggauucauuuauuuggcaacucaguaagcgcuaauauaugucauauguaucauuucug

SEQ ID NO: 2242881 - RNA, 65 nt, Homo sapiens
uucuuuuaauugugggggagugugaguugcuuacguccuuacucaaaucccucagaauuauagaa

SEQ ID NO: 2242882 - RNA, 66 nt, Homo sapiens
gaugcuacucauuucaccuauauuauugaauuucaucugugaggacuccgugagguggguaguauc

SEQ ID NO: 2242883 - RNA, 59 nt, Homo sapiens
ugcuuuucauagaucaugcuuuuggaaaagucuuccuaaagccagcauccuggacagca

SEQ ID NO: 2242884 - RNA, 129 nt, Homo sapiens
cccaagagcagcccccauaccuugccacgaucucuggcuggcgagacagcuccaucacugugaacgccaagugguuggcagaggucucgugaccugugggaagggaggacggugguugcuccacauggg

SEQ ID NO: 2242885 - RNA, 58 nt, Homo sapiens
ucauguguugcacugaggaccugccaccuuaugugguguuuuugccaaaaaugcauga

SEQ ID NO: 2242886 - RNA, 57 nt, Homo sapiens
gcagagcuccuucauucuaugaauguuagcuaaauuauggacaugguuaggcuuugu

SEQ ID NO: 2242887 - RNA, 63 nt, Homo sapiens
uacaguaaauuucugugcuuucauagagaaaagauauugugggggcacugggaauuuauggug

SEQ ID NO: 2242888 - RNA, 66 nt, Homo sapiens
caauuuaguaaauuuuucaucuugccugcacuuaaagguuggcuaugaagucguuacuaccaauug

SEQ ID NO: 2242889 - RNA, 57 nt, Homo sapiens
ggcgcaagcgauucuccaccuccgucccccaugcagcugguacuagaggcuugcgcc

SEQ ID NO: 2242890 - RNA, 81 nt, Homo sapiens
cucuguuaagucuuaugaccacugucuaagauaggugagccaucuuaccuguuuuacagauguggaaggagaagcucagag

SEQ ID NO: 2242891 - RNA, 70 nt, Homo sapiens
cuaaaugcuuugcacguauuaucucagucaacucucacaaugaccauaugagauagguaccgaagcuuag

SEQ ID NO: 2242892 - RNA, 76 nt, Homo sapiens
cauccagcccugggaugugcugcaugggacggucugcccagggccuuccaaguggggcacgugccaccgcucugug

SEQ ID NO: 2242893 - RNA, 69 nt, Homo sapiens
accaggcaucucauuccuucugggcugauuugguccugauggccacagcagggaguggggacagcuggu

SEQ ID NO: 2242894 - RNA, 74 nt, Homo sapiens
uccagucaagggauuaaugugcucacuuggguaauugauagugauuaucaaagugaaauauuaguuaugaugga

SEQ ID NO: 2242895 - RNA, 60 nt, Homo sapiens
uauguguguacauggcuuuuauaacaagaaaugggagaaccuaaagcuauguaacauaua

SEQ ID NO: 2242896 - RNA, 82 nt, Homo sapiens
gcaccgucugucccaucacaguuuuaccauuugguacucucuggagcauugccauggccuagaccugugauuaaauuggugc

SEQ ID NO: 2242897 - RNA, 57 nt, Homo sapiens
agucuuugcugccuccucguauaauuucuaaaaauugaaauacaagcagcagagauu

SEQ ID NO: 2242898 - RNA, 70 nt, Homo sapiens
cuauucugauugcaguagucugaaagcaauagucagacuauugcuuugccucugcuguccauuacgguag

SEQ ID NO: 2242899 - RNA, 118 nt, Homo sapiens
uuucuuguaugcacauaccuucuuccaguguuugacucaccuuuacguucucuuaaugaugccuuguaaugaacaaagguucuucaaagcuggaggcaucacauuaccugacuugaaa

SEQ ID NO: 2242900 - RNA, 67 nt, Homo sapiens
cacugugccagcuggcaaaagaaaacuauuuaaugggcccaucuccauuuuugcagagcugguagug

SEQ ID NO: 2242901 - RNA, 79 nt, Homo sapiens
uuggaccucaauuuuaauuuuguuauagaacucugugagaaaaagcuuauagacacguuguaacaaacacuguggccaa

SEQ ID NO: 2242902 - RNA, 100 nt, Homo sapiens
gaggcaggagaauugcuugaacccaggaaguggaggcuucagugagcugagaacacgccacugcacuccaguccugggcaacagagcaagacucugucuc

SEQ ID NO: 2242903 - RNA, 81 nt, Homo sapiens
agugguugggaagauggcaagaauggaacaggagagccguggauucaggcucgucugaguucuagucucaaucccaccauu

SEQ ID NO: 2242904 - RNA, 78 nt, Homo sapiens
cagcauuaugcacuuuacucauuuaagguauguugugaugugaacaaaucagccuguagaagaguagaugaccugcug

SEQ ID NO: 2242905 - RNA, 64 nt, Homo sapiens
ucccacugggggucacccuuuuuccaacaucaaaugucuggaaggguggccuccugagguggga

SEQ ID NO: 2242906 - RNA, 76 nt, Homo sapiens
aguggcaaggggaggguguuuaagagcagaggaguggcaggucugauuuguaguuugaaagcucccucuggguacu

SEQ ID NO: 2242907 - RNA, 65 nt, Homo sapiens
uuuacaacauaggccccaagaagaaggcuuuguuggacuugacucugugcggucuguguuaugaa

SEQ ID NO: 2242908 - RNA, 59 nt, Homo sapiens
gugaaguguuuuuucaggcaugucuacuauugcaguuugcauggccucugacacaucac

SEQ ID NO: 2242909 - RNA, 66 nt, Homo sapiens
gucacauuccuauuuucaucuuccuugguguuucuagcacuggaaguaaccaugaauggaauugac

SEQ ID NO: 2242910 - RNA, 113 nt, Homo sapiens
cugccuuuggggcuccaguccaugccucaggugucacauggcacugcgggcuucuugguugccaagaggcagaccacaggccaucuuggggaggacuuuauauucaagugcag

SEQ ID NO: 2242911 - RNA, 89 nt, Homo sapiens
ucauauaacucuguuuuuuucaugcauuuaauaauuguucuugcugcugugucuuuaucuucuuguaugaaaaggaauagauugaauga

SEQ ID NO: 2242912 - RNA, 92 nt, Homo sapiens
gaagcauuggcuacuuuuaaauguagauauagaaaaagacugacccacucaggauuggguuauauguuucuguuuggaggcaucccugcuuc

SEQ ID NO: 2242913 - RNA, 112 nt, Homo sapiens
gcagugcauggugguguacaccuguagucccagcuacuuagggggcugagguaggaggauuaccucagcccggggaaguugaggcugcagugaaccaugaucacaccacugc

SEQ ID NO: 2242914 - RNA, 65 nt, Homo sapiens
aaccucguauguaaugcaauauuaacucuuggaaaagaggauggaggagcauucaugacgagguu

SEQ ID NO: 2242915 - RNA, 55 nt, Homo sapiens
cgcugugguauuauuagaaauauccaagggagauauuacuccuaauaucacagug

SEQ ID NO: 2242916 - RNA, 72 nt, Homo sapiens
ccugggcaacacagugagaucccaucucucuuuuuuccuuuuuugagacagagucuugcuccguugcccagg

SEQ ID NO: 2242917 - RNA, 66 nt, Homo sapiens
aguuucaagaccuaugugaagaaucccuuucaaaaguuacaugguucuuauauaguuucugaggcu

SEQ ID NO: 2242918 - RNA, 82 nt, Homo sapiens
gguacuuagggauccugggacuccagguaccacucuacacaccugcuccagguacuuagagauuccaggaacuccagguacc

SEQ ID NO: 2242919 - RNA, 79 nt, Homo sapiens
ucacuugagcccuggaguuugaggcugcagugagcucaaguaauugugucacuguacuccaaccuaggugacagaguga

SEQ ID NO: 2242920 - RNA, 76 nt, Homo sapiens
uugcuggaaccugggaggcggaggcugcagugagccaagauugugccacugcacuccagccuggaccacagagcaa

SEQ ID NO: 2242921 - RNA, 74 nt, Homo sapiens
uagcuuuucuagauguaggcagguaaauuuaaguuccagucuacuugauagugccuuuuauaucucuaaugcug

SEQ ID NO: 2242922 - RNA, 120 nt, Homo sapiens
guuuuuaauauggucaauaguauuaaagcuuggaagccuagauucuuuucuuuugaccccaaguggaaaagaaagucuuccuuguuuguuugcuuuuuuuuuccuugugacugugaaagc

SEQ ID NO: 2242923 - RNA, 76 nt, Homo sapiens
gaaaacagacuaauacaguaaggcacuuugguuuugaucuuaagugcauguauuaguguagucucugaauguuuuc

SEQ ID NO: 2242924 - RNA, 55 nt, Homo sapiens
ccauuaggcuaucauuuaguaaauuacuacauuguucuaaaugggucccuagugg

SEQ ID NO: 2242925 - RNA, 64 nt, Homo sapiens
agggucacuuccagacagugccauggcauuuguaagcuguaauggcccuggugggagugucuuu

SEQ ID NO: 2242926 - RNA, 64 nt, Homo sapiens
ucugauagaugugaccuguagaugaucaguuucaaaacauauuuauacguugucauuuaucagg

SEQ ID NO: 2242927 - RNA, 80 nt, Homo sapiens
ggaggccgaaauccaaggucaaggcguggcagggccaguuccucugagcuccuccccuuggcuuucaggugaccgucuuc

SEQ ID NO: 2242928 - RNA, 80 nt, Homo sapiens
uccagucacaucagaaaguugagugcugaucugauuauuucacuuaauugcauaaaauucaacucugugacaucccugga

SEQ ID NO: 2242929 - RNA, 77 nt, Homo sapiens
auguucuguguaauaaucguggacuauguucugugugcagaugagaaugcauguucuaugguugauggguggaauau

SEQ ID NO: 2242930 - RNA, 74 nt, Homo sapiens
ucuuaacugaucaaauaugaggagaagagaaaugaucuuagaccucucuuuugggccucuugucagacuugaga

SEQ ID NO: 2242931 - RNA, 78 nt, Homo sapiens
ccucagccuuccaaaguacugggauuggccgggugugguggcucacgccuguaaucccagcacuuugggaggccgagg

SEQ ID NO: 2242932 - RNA, 61 nt, Homo sapiens
augaauccauuccugccacagaauuugauugcgggccuacugugugcucggauggacucgu

SEQ ID NO: 2242933 - RNA, 109 nt, Homo sapiens
uucaaaguaauuccaguuaagccauucuuuauuuuacauuuugaauaacaggguaagccauaacuccauguuaaaguaauugaaauggccuuuagcagauaauagugaa

SEQ ID NO: 2242934 - RNA, 69 nt, Homo sapiens
ugggggcacugaguauguuuagaaguaaaggaagaaguucugaacuguaugaacaauuuauauucccca

SEQ ID NO: 2242935 - RNA, 55 nt, Homo sapiens
uuucccugaaggcucugaagucccauacgggaaaccaugagggccuuccgggaag

SEQ ID NO: 2242936 - RNA, 75 nt, Homo sapiens
uagaccguaaaugauaugaucgcccuagcuugacuccacuggucauccuuuaagauuaauguuagcuacuguuua

SEQ ID NO: 2242937 - RNA, 70 nt, Homo sapiens
aucuauuagacaucugaauaaggguaagaacaggcaguuaauaccugagucuagagucuagaaaauggau

SEQ ID NO: 2242938 - RNA, 68 nt, Homo sapiens
uucugcuguuguuuuuguugaagguguuuucugauccaaauaaagugucacaaugaacagcagcagaa

SEQ ID NO: 2242939 - RNA, 57 nt, Homo sapiens
auuuggaaaaauccaccuugaucucauagcaaaccugagaugguggcuguuucaagu

SEQ ID NO: 2242940 - RNA, 82 nt, Homo sapiens
ugcugggcuuaauaccuagguaauggguugucaggugcagcaaaccaccaugacacauguuuaccuauguaacaaaucugca

SEQ ID NO: 2242941 - RNA, 63 nt, Homo sapiens
ccuaagcucucaggguucaggaggcuacccaggaacaaugagcccuugugccugaagcuuggg

SEQ ID NO: 2242942 - RNA, 120 nt, Homo sapiens
ggauguuacuccuaaugucacagggauguacacccugugauauuauucauaguguaccagagggauauuagcacuaaugucacgauguguguacacccugugauauuauuugucauaucc

SEQ ID NO: 2242943 - RNA, 63 nt, Homo sapiens
uacuuagaugaugcuuaaacaugcacagaauuacacuuggcuguacacauauacaucuaagua

SEQ ID NO: 2242944 - RNA, 69 nt, Homo sapiens
gcagaacucacuggguguaaaacauguagcaugguuucuugcucauaguaggugcucagugaaaauugc

SEQ ID NO: 2242945 - RNA, 58 nt, Homo sapiens
agucuuagcucuguuuccucagcauuccuagcuaugcagugugcaacagauuaagacu

SEQ ID NO: 2242946 - RNA, 64 nt, Homo sapiens
gaguuacacaguugguaggggcagagccaggugacaggcagucugaccccugugcuguggacuc

SEQ ID NO: 2242947 - RNA, 106 nt, Homo sapiens
cuggaauguuuggugacugugaugcuuuucucagugaaguuuagaacauguuauugaacauuuuucucuuuccacugagauuucauagacauacagaaauauccag

SEQ ID NO: 2242948 - RNA, 78 nt, Homo sapiens
acugaaagugcuguccuaccuuugggaaauggaggccucguuucuccagcuuuuauuaggaaggacagccugaacagu

SEQ ID NO: 2242949 - RNA, 78 nt, Homo sapiens
cauccgucuaugucauacagaggaaauguuccucacaugcaugugauaggagauuuucaucuguaaaugcccugggug

SEQ ID NO: 2242950 - RNA, 82 nt, Homo sapiens
uuugcagaaugcuuuuaucuguuuuucucuggagaaaacuaaucuucggugaguagauggguuaaagucuaaaauauguaag

SEQ ID NO: 2242951 - RNA, 66 nt, Homo sapiens
uaauucuauuagugccuaagucuuaggggcugacaauuaggcucuaagggaggcauaguauaauua

SEQ ID NO: 2242952 - RNA, 76 nt, Homo sapiens
gucccauuccaucuugcauuugcuaaaaugcauuuggaaucacauuauuauagauuaugcaagauuggaagacggc

SEQ ID NO: 2242953 - RNA, 77 nt, Homo sapiens
ggcagaaauuucuaagcagccacuuccaagaagcuuuggaaagaaauauccagggaagugcuguguggaagucugcc

SEQ ID NO: 2242954 - RNA, 61 nt, Homo sapiens
gguacagcuaguuaaacauuugcaggacaaauauaaccgaauguguagcaggugcugugcc

SEQ ID NO: 2242955 - RNA, 76 nt, Homo sapiens
ucgcucuguugccuaggcuggagugcaguggcaugaccucggcucacugcaaccuccgccucccggguucaagcga

SEQ ID NO: 2242956 - RNA, 59 nt, Homo sapiens
uugccuguucuuugagucucugggucacaggauauaucuaugacuagaggacaugguaa

SEQ ID NO: 2242957 - RNA, 89 nt, Homo sapiens
ggcaaggccagaguuggcauggucugcccaaguuucccuaauucacuagaggagaggcagccugugccgaagucucucauggcccaguc

SEQ ID NO: 2242958 - RNA, 125 nt, Homo sapiens
guuugaauguacauuuuuaaaguucuucaauucaugagugguuuuuuucugccuuauagccaguccccacuauauuucagcuagauuuagcaaaagaucagucauugaaagaauacauuucagau

SEQ ID NO: 2242959 - RNA, 69 nt, Homo sapiens
gguuugauaugggcuuuguuuuguacuagauauauaucucuaaggcauauuauaaagccauauuggacc

SEQ ID NO: 2242960 - RNA, 74 nt, Homo sapiens
uguaacugcuuagaagguuuuaguuaucacuuccuaucauauagaagcuuacuuuagauuuuuuuccaguugca

SEQ ID NO: 2242961 - RNA, 93 nt, Homo sapiens
guggcuacagaagagagacaccuuaugcuugagaaaaggaaaauaaagaguaaagaggacuuugucuugcagcuuaggcaucagcuucgccau

SEQ ID NO: 2242962 - RNA, 73 nt, Homo sapiens
aguggagucagguggagacagaucuucaguugacaaagccacccugacacgauucuucacuuuucacuucacu

SEQ ID NO: 2242963 - RNA, 63 nt, Homo sapiens
ggcugugguguugucauaaauagcucuuacuauuuuugagauauguuucuucaauaccuaguu

SEQ ID NO: 2242964 - RNA, 55 nt, Homo sapiens
uggcagcagcaaauggcauaucaucuuccgugaucuuggagucaucaugcugcua

SEQ ID NO: 2242965 - RNA, 86 nt, Homo sapiens
uaaguucuagggugcacgugcacaaugugcagguuuguuacauagguauacaugugccauguugguuugcugcacccauuaacuug

SEQ ID NO: 2242966 - RNA, 73 nt, Homo sapiens
uucagcuguuguugggguauaggaaugcuaguaauuuuuguauauugauuuuguauccugcaacuuggcugaa

SEQ ID NO: 2242967 - RNA, 82 nt, Homo sapiens
ggcugggauaagugagugauucaguguuagcuuuagugucaauagaacuugcacugaaauauucaacuuuuuucccacagcc

SEQ ID NO: 2242968 - RNA, 59 nt, Homo sapiens
gaggagaagcagcauucugguuuuuggaauuuucagccuuuaugugcuguuuauuccuc

SEQ ID NO: 2242969 - RNA, 66 nt, Homo sapiens
ucagagacuucccuagaacacauggagggauaucgucucuuacuuaauucaggggaaguauuuuga

SEQ ID NO: 2242970 - RNA, 80 nt, Homo sapiens
gcaauugcacucuuagguguacacccaaaggcauugaaaacagacacucaggcagauacuuguacaccaguguauauugc

SEQ ID NO: 2242971 - RNA, 72 nt, Homo sapiens
cugaugggaaugaagagaaccuucccacaaaacucaaauucuggggagguaaguuuuucguuugccauucag

SEQ ID NO: 2242972 - RNA, 85 nt, Homo sapiens
agaaaugaguuuaaaugguagucguuucaguuaagaucuaagaaagacuuugggaaugaguuuaucauuuauuauaauuauuuuu

SEQ ID NO: 2242973 - RNA, 60 nt, Homo sapiens
uuaaggaaggagucuuaaaugggugccuacuuugugcacuuagacucucuuugucuuuaa

SEQ ID NO: 2242974 - RNA, 82 nt, Homo sapiens
uuauuaauaaugcugauguuggccucugggcuuuggcaaacacuuuuggucaaagcaugaaucgacucggcaaccauaauga

SEQ ID NO: 2242975 - RNA, 74 nt, Homo sapiens
agggaacacuuucacacuguuggugggaauguaaacuaguacagccacuguggaaaacaguguggagauuccuu

SEQ ID NO: 2242976 - RNA, 70 nt, Homo sapiens
ugcggccuacugucaugugaugugaguuccuggagggcaggaguucugaccuacaugcagcaggcacgca

SEQ ID NO: 2242977 - RNA, 97 nt, Homo sapiens
aucuuuauccaaucguuuauuuuaaggcuuucccuauguaaaaugauaaucuuuaucuugugucuguaaacuuuaaugaauugauguuggugaaggu

SEQ ID NO: 2242978 - RNA, 67 nt, Homo sapiens
gaugaagugguagacacagaaaacaaaaggagaccgguuuuuuguacgccuguguccaucagucauu

SEQ ID NO: 2242979 - RNA, 77 nt, Homo sapiens
ggcuuuuuuggauggucagaggguuucugugagugucucauaccccacguuuucaucuucugaccauucuuugagcu

SEQ ID NO: 2242980 - RNA, 62 nt, Homo sapiens
aggauuuuguuuggguucuuuugaaguugaaaagauuuucaaaagagcucaccagaauaucu

SEQ ID NO: 2242981 - RNA, 60 nt, Homo sapiens
gugauguuuaggacaauguucguuuuuuggcuuaugaaugccaaauuguuccagcgucac

SEQ ID NO: 2242982 - RNA, 85 nt, Homo sapiens
gaugugauuuccacacuguguaauucauucacuuacgguguacaguccagugggucuuagcaugcucgguguugacagucacauc

SEQ ID NO: 2242983 - RNA, 56 nt, Homo sapiens
caugaagcauguuuugucaugaggcaacucaguugacaaccucaugcuuugucaug

SEQ ID NO: 2242984 - RNA, 86 nt, Homo sapiens
uaaguucuaggguacacgugcacaacaugcagauuuguuacauagguauacaugugccauguugguuugcugcacccaucaacuug

SEQ ID NO: 2242985 - RNA, 55 nt, Homo sapiens
cccagaaguugaggcugcagugagccgugaucaugcuacugcaccucaaccuggg

SEQ ID NO: 2242986 - RNA, 89 nt, Homo sapiens
uucuuuuaaacuaucagggacugaaugaacauaggacuugaguaaagauauugcuuaagcuaguuuauucaggaaagccgcaagaagaa

SEQ ID NO: 2242987 - RNA, 64 nt, Homo sapiens
ugugugacuguggauugagaggagguaggguuaagucuuaauuccaccauugacuaguuacaua

SEQ ID NO: 2242988 - RNA, 80 nt, Homo sapiens
agccacauuuuuuggugaccaaaacuuauucucaacuaaaaauccuuuagguuugucacccugaauguaagauuuagguu

SEQ ID NO: 2242989 - RNA, 79 nt, Homo sapiens
guguguguuuauuagagguaggauuucaccauguuggccaggcuggucuagaacuccugaccucaaaugauccacccac

SEQ ID NO: 2242990 - RNA, 58 nt, Homo sapiens
gggauuugugguuauagagucucccugugucuccaaucacaguauagccagccauccc

SEQ ID NO: 2242991 - RNA, 58 nt, Homo sapiens
uuaggcuuauauucccaucagaacaucugguacaacugguggaagauaaguagccuga

SEQ ID NO: 2242992 - RNA, 100 nt, Homo sapiens
guaguguuguucacgaagaauuuuguuuuauuuucuucuguaauuccuuuuuuccccccggaguauaaugacagccagauucuucucuaucaucuacugc

SEQ ID NO: 2242993 - RNA, 56 nt, Homo sapiens
uagagacagugaauuuuuauugcuaggucugucagguggugagaaugacuguucug

SEQ ID NO: 2242994 - RNA, 87 nt, Homo sapiens
caaaaugauagcauguuugguagugaauaugguagucagacacugguuauaucauuuuaccauuauuaacuauguaauuucauuuug

SEQ ID NO: 2242995 - RNA, 58 nt, Homo sapiens
gcccaacaaccagaacucaguccacugaaagguaggaaaugcagucuuuguucugggc

SEQ ID NO: 2242996 - RNA, 62 nt, Homo sapiens
aacucacggugcaggcuucugggaugugcagaugugauccuagccuuagucacuggugaguu

SEQ ID NO: 2242997 - RNA, 55 nt, Homo sapiens
ugaaugugguugcuacuuaaggugguucucagccccuugguuaucuucccauuca

SEQ ID NO: 2242998 - RNA, 85 nt, Homo sapiens
gcuaugcaauguuucuagcuuuuuaugacaaucuuggccaaagcaggcuagauggcaauaagaaagacuagaauuguugcauggc

SEQ ID NO: 2242999 - RNA, 78 nt, Homo sapiens
gauacagacagcauuaugagguuaaugugcaauaucguuacaccaugaauuuuagcuccaugauaguaugucuguguc

SEQ ID NO: 2243000 - RNA, 80 nt, Homo sapiens
cugcuggauucuguuugcuaguauucuauuaagaauuuuugcauugauguucaucagggauauuggccuggauugagcag

SEQ ID NO: 2243001 - RNA, 62 nt, Homo sapiens
ccuacuugauaaugcuaguuuaugcuaagaaaacauuuucauauagaccauugguagguagg

SEQ ID NO: 2243002 - RNA, 68 nt, Homo sapiens
uccacuagaguaaaugauacacauguuuauuugagcccuaaucugccauggugucuuauuuuugugga

SEQ ID NO: 2243003 - RNA, 70 nt, Homo sapiens
cucgaacacaggaggcggaggcugcagugauccgagaucccgccacugcacuccagccucggugacagag

SEQ ID NO: 2243004 - RNA, 55 nt, Homo sapiens
gagagaaugcagucuagauuccaucucucuaugugguuaaggcagcauuacucuu

SEQ ID NO: 2243005 - RNA, 67 nt, Homo sapiens
cuguagcagccacacuugauaacuucgacagguucccaguugucaucucauuggcugcucuccacag

SEQ ID NO: 2243006 - RNA, 76 nt, Homo sapiens
guagcaggaguucuguaaauguuacuucuucccuucuugcuuggaaugacugucuugcagaggcuauaucugcuac

SEQ ID NO: 2243007 - RNA, 57 nt, Homo sapiens
ugagacugaguuuugcucguugcccaggcuggagugcaauggugcaaucucggcuca

SEQ ID NO: 2243008 - RNA, 56 nt, Homo sapiens
uucuccauaucugugcugauucaccucacacuagaucagugcaauucuauggggaa

SEQ ID NO: 2243009 - RNA, 55 nt, Homo sapiens
ugcaaugucuucugaggggagcaaaauggccaugcacucuuaggaaauauaugua

SEQ ID NO: 2243010 - RNA, 130 nt, Homo sapiens
cucaaaauuucuuugacuacuugggcccuuuuguaguuccacacagauuuuaugauuuuuaaaauauuucuuugaggaaugucauuuguguuuugacagggauugcaucaaauguguagauucuuuuggg

SEQ ID NO: 2243011 - RNA, 110 nt, Homo sapiens
cccuuuguggcaaauugagacgggggaaaacuauuagguuggggcgaaaguaauuucuguuucugccauuacuuuugccccaaccuaauaccucccagcaaaaugcaggg

SEQ ID NO: 2243012 - RNA, 56 nt, Homo sapiens
aagcaggugugggaggaaauggccauguccuugggauuuccagccuuaccuugcuu

SEQ ID NO: 2243013 - RNA, 98 nt, Homo sapiens
cuugccuuuccaguuuuguaggugcaguuugaaaguagaaacaugaaguuuaacugcauuauuuuuaaaaaauugccucgaaugcagaaauaggcagg

SEQ ID NO: 2243014 - RNA, 89 nt, Homo sapiens
acaauaaugaauauugcuggaaagugaaugugcuggaauagcuucagagagcuuaucuccauauauuuucuuaauuggcacauuauugu

SEQ ID NO: 2243015 - RNA, 64 nt, Homo sapiens
agcccucccaguucaaugauauggaaacuguacucuacaguguugcagacaagaacacagggcu

SEQ ID NO: 2243016 - RNA, 55 nt, Homo sapiens
gcgggcagagcucaaggcaaggcccucaguuccuaugacuuguuuucuggucugc

SEQ ID NO: 2243017 - RNA, 85 nt, Homo sapiens
aaagugcagauuccuuggcauugccccuggaauuuugauucagcagauuugagguggggccaaaugcuacaguagucugcauuuu

SEQ ID NO: 2243018 - RNA, 61 nt, Homo sapiens
gcaguuaugugaaucauguguuauaagagggggcuuaaaggcaugguuagacaugguuagc

SEQ ID NO: 2243019 - RNA, 87 nt, Homo sapiens
guguauucugauacugaaagcuguugguuuucagcugaggguaauauuuaauugggaagccauagcuuuuaucuuauuguuauacac

SEQ ID NO: 2243020 - RNA, 62 nt, Homo sapiens
cagccaaucugauucuauaccauuucuuagaacaaagaagagugcuauagauuagauuucug

SEQ ID NO: 2243021 - RNA, 58 nt, Homo sapiens
cacuucacugugcuuaaauucugcugaauccucaguguuuacuagcacaugugaagug

SEQ ID NO: 2243022 - RNA, 103 nt, Homo sapiens
uugagauggagucuugcucuguugccuaggcuggagugcaguggcgugaucucggcucacugcaaccucugccucccggguucacacaauucuccuaccucag

SEQ ID NO: 2243023 - RNA, 57 nt, Homo sapiens
aacaagaagagagggacguaaucccacugcuuggaaugcgauccucaauccucuguu

SEQ ID NO: 2243024 - RNA, 68 nt, Homo sapiens
aaagggugugcagcuaucucauuguuguuuuaauuuacaauuuccuaaugauauguugagcacccuuu

SEQ ID NO: 2243025 - RNA, 93 nt, Homo sapiens
ggaucuuacauucaaauacagggauauaaucauugucagugccaggggagaggaacacugccuaaugacuuauguuuuaaaugugugagaucc

SEQ ID NO: 2243026 - RNA, 58 nt, Homo sapiens
uaccucuuuccccaggccagagaucugcacccuuucuuuguacugagccaagauggua

SEQ ID NO: 2243027 - RNA, 64 nt, Homo sapiens
uagggcaaacuauauuauuuacucauuacaaaaacuccugugagauugauaugguuuggcucug

SEQ ID NO: 2243028 - RNA, 55 nt, Homo sapiens
ugacuugauccauggggcuccaggaaaaugugcuaagagcaacaggaacaaguua

SEQ ID NO: 2243029 - RNA, 72 nt, Homo sapiens
ggacaucacauggggaagggacuagcuucuuguaaaaccagcagucccacucccaugaugaccuauuagucc

SEQ ID NO: 2243030 - RNA, 60 nt, Homo sapiens
uucauuacugauaugauucugcaguuuuuaaugauuguacuauuuuuaucagugauagaa

SEQ ID NO: 2243031 - RNA, 82 nt, Homo sapiens
cucauggauugcuuaggcuuccuuacaguauggaaaucacagaauagccaagcuuguucuaggaagcuagcuucuuccagag

SEQ ID NO: 2243032 - RNA, 64 nt, Homo sapiens
ugaguguuuuuaucaugaaaggguauuagauuuuaucgcauccuucuguuuauggagaugcuca

SEQ ID NO: 2243033 - RNA, 83 nt, Homo sapiens
uuauaguuaaagccauaccugagagaguucagaaagcaagcaacuaaucuauuauuucaguguaugucuuccuaaagcuguag

SEQ ID NO: 2243034 - RNA, 85 nt, Homo sapiens
auaaucccauagacacugcauauuuuuuuaaguccugaucuucacaguagagcuuaaagaaaguguaguauuguaauguaauuau

SEQ ID NO: 2243035 - RNA, 84 nt, Homo sapiens
uggauugugagaagcaguauuguugaaauguccauacugcucaaagcaauguauagauucaauacaaucucuaucaaaauacca

SEQ ID NO: 2243036 - RNA, 79 nt, Homo sapiens
uugccaccuggacacuuugggcuccucuuaccuuuaaguugacaggcuaagaagggacuuacaguguucguggggguga

SEQ ID NO: 2243037 - RNA, 90 nt, Homo sapiens
gugcggguccugaugagucuuugucuuaaacuuuacagcuuuuucauacagucuguguaguacuagauugagcaaucuuuaaaucugcac

SEQ ID NO: 2243038 - RNA, 58 nt, Homo sapiens
uuggaugccagacccaugugccaaauaccugaauuggcauaugguauuugauaucuga

SEQ ID NO: 2243039 - RNA, 56 nt, Homo sapiens
cccaggcuggagugcaguggugcagucauggcccacugcacugucaaccuccuggg

SEQ ID NO: 2243040 - RNA, 69 nt, Homo sapiens
ugggguuuuuaaagucauaauacuuuguccaguagaugcagaguugcugguaguuuaugacuaauucca

SEQ ID NO: 2243041 - RNA, 77 nt, Homo sapiens
uaccuggaaagagguuguaccuaaaguguucucuguauuggcggaaaauguuucccgggcaaccucuuuucauugug

SEQ ID NO: 2243042 - RNA, 64 nt, Homo sapiens
uucgguuugccaguauuuuauugaggauuuuuacacugaugaucaucacggauacuggccugaa

SEQ ID NO: 2243043 - RNA, 83 nt, Homo sapiens
ccauuaucauccucacauuguguagccugcucacugggcuggaaaaacccuguguguguuuacaaaugugaaaagugaagugg

SEQ ID NO: 2243044 - RNA, 65 nt, Homo sapiens
uuucacuagggagaaacugaggcuuaggggccaccaugaucgagucucagccuuccuggcagaaa

SEQ ID NO: 2243045 - RNA, 81 nt, Homo sapiens
cuuugugauaguuacuaaacauuucuuaggaagucucaguuuucugagaugcaaaaugagaauuguugcagagccauaaag

SEQ ID NO: 2243046 - RNA, 76 nt, Homo sapiens
ucacucaggcguccaggcuggaguguaguggugcgaucacagcucauugcagucucgaccucucaagcucaaguga

SEQ ID NO: 2243047 - RNA, 75 nt, Homo sapiens
cauucccaguuuuucauuuauacuaguaaauguaacauacaggaaacuacauuguaaauguaaacgcuguggaug

SEQ ID NO: 2243048 - RNA, 76 nt, Homo sapiens
guaucuuuauagcaaugugccacucucugugccaauuuucuguguuagucuguuuuguauugcuauaaaggaauac

SEQ ID NO: 2243049 - RNA, 107 nt, Homo sapiens
gaucagcggcagcauucgauucucauaggagcaugaacccuacugugaacugcacacacagggaucuagguugcaugcuccuuaugagaaucuaaugccugaugauc

SEQ ID NO: 2243050 - RNA, 109 nt, Homo sapiens
cuguucaacacuuuggcuuuuuuguucuuggagugcgugucugaguuuuucuuaaugaauuguaaaaauucuucauguauucaagacacaagaucuuuguugguuauag

SEQ ID NO: 2243051 - RNA, 60 nt, Homo sapiens
gagaaugaugauuuuaaauuucacccaugucccuacaaaggacaugaagucaucauuuuu

SEQ ID NO: 2243052 - RNA, 68 nt, Homo sapiens
cguggguucaagugauucuugugccuuagccuccugaguagcuggaaauacaagcacuugaccccacg

SEQ ID NO: 2243053 - RNA, 57 nt, Homo sapiens
gcuauacauaaugcacauggguugcuaaauuaguaacacaccugcauggugugaagu

SEQ ID NO: 2243054 - RNA, 76 nt, Homo sapiens
cuggccucucucagucaguuuucugaagugacagcacuaagcaacuguucuugguuuauugauggagaggagccag

SEQ ID NO: 2243055 - RNA, 57 nt, Homo sapiens
gcccaguuuagagugcaauggugugaacacgggucauugcaguuucaacuccagggc

SEQ ID NO: 2243056 - RNA, 65 nt, Homo sapiens
gauuauaaaguuuuaggauccaauauaaaacaaaaguuuuugagaucuuuuaggccuuuguaauc

SEQ ID NO: 2243057 - RNA, 70 nt, Homo sapiens
cugacuucaaaaaauuaauguguauccagggacauuuuaaaaaccuguacacaguguuuauugugguuag

SEQ ID NO: 2243058 - RNA, 65 nt, Homo sapiens
acagcuggacacaucaugugaccaagguucgccaaugagcuaugagugaaaaugaugugugcugu

SEQ ID NO: 2243059 - RNA, 62 nt, Homo sapiens
gccuuuuguccuggguuccugaagcagcucaagacagcuucagagcacuaaagguaaaaggc

SEQ ID NO: 2243060 - RNA, 113 nt, Homo sapiens
ggucuucucacucugucacacccugguuggagugcagcuugugcgaucagcagugagccaugauugcacaucugcacuacagccugggugugacagugugacacacaaagauc

SEQ ID NO: 2243061 - RNA, 98 nt, Homo sapiens
guucacuaaauguaagaguccuuagucucucuugcaguuaccaaguaaugaaggcauugugguaggaugaagagaugaauuugauacauucagugagc

SEQ ID NO: 2243062 - RNA, 55 nt, Homo sapiens
uugagauggagucuugcucuguggcccaggccagaguucaguggcaccaucucag

SEQ ID NO: 2243063 - RNA, 59 nt, Homo sapiens
gcaaauacuguguguacaaaguugugcaguaauuugagcaauaaaguuacacaguuugu

SEQ ID NO: 2243064 - RNA, 67 nt, Homo sapiens
gugugauuguuaauuuuaggugucaacuuuccuggauuaaggaauaccugaagagcuaauaaagcau

SEQ ID NO: 2243065 - RNA, 129 nt, Homo sapiens
ugacauugugagaguuaaaugcaguuuauugaaaccugaaauaguuaaguugccuagucuaguaauggaguuaaggucacuuuauuugaagguacuaagcuuacugcauaaguaaagcuggcagaguua

SEQ ID NO: 2243066 - RNA, 82 nt, Homo sapiens
uauaguuaaaggaauucaagcauugccaagcaaguggagauacauuugagaucuugauauguuugaaaacucuuugucuaug

SEQ ID NO: 2243067 - RNA, 120 nt, Homo sapiens
guuuacagguucccgcuguggugaaugagugggugacagugaacacguacccacuguggugagugagugggugacagugaacagguuaccacugugaugcaugagguggggacagugaac

SEQ ID NO: 2243068 - RNA, 130 nt, Homo sapiens
cuuccaaaauaucuucuaaauauauguuguagauuaaguugugccugaaaacuuguaaucacaaaaaaaucacaaguaucaaauauaaacuuguauuuauucagcagcucaccugaucauuauuuggggg

SEQ ID NO: 2243069 - RNA, 75 nt, Homo sapiens
gggggcuccaggcgagaauguguucccgccuuucccagcgucuagaggcacccacaucccuugcucggggccccu

SEQ ID NO: 2243070 - RNA, 76 nt, Homo sapiens
acugacuuaagcuacuuuggugguuccuuauuauuagguucuuuuugguaaguaccaauagcuuccauuagucagu

SEQ ID NO: 2243071 - RNA, 56 nt, Homo sapiens
cuagaggcacagccuaggcacuggggcuaccagcuccuagggcucugugccucugg

SEQ ID NO: 2243072 - RNA, 56 nt, Homo sapiens
cauugcauuuucuuuguaccuuugucaaagaucaguggugccaagaauauucaaug

SEQ ID NO: 2243073 - RNA, 76 nt, Homo sapiens
ccuuacuaguguuggauuuuaacaaacuaggugagaagaagccucagcuaguugauaaaauucauuuguaaugagg

SEQ ID NO: 2243074 - RNA, 60 nt, Homo sapiens
uguuucaucagccagggucagucucuguugcuugcaacccagaacccugacugaggaaca

SEQ ID NO: 2243075 - RNA, 56 nt, Homo sapiens
ugaauagugcugcaauaaacauaugugugcacgugucuuuguagcagcaugauuua

SEQ ID NO: 2243076 - RNA, 63 nt, Homo sapiens
uugaacccgggagagguugcagugagccgagaucgcgccauugcaccccagccugggugacaa

SEQ ID NO: 2243077 - RNA, 58 nt, Homo sapiens
gcauguucagcuuuaguauguuuucagaaaugcauuacauaaagaagcaggacauugu

SEQ ID NO: 2243078 - RNA, 114 nt, Homo sapiens
uugcuauuugcauagucauuucauuggauaguuuaugaaaaauggaagggaaaguauuuucuuacagugccauuuuucacaagacucacuuccugaugagaacaugagaagcag

SEQ ID NO: 2243079 - RNA, 66 nt, Homo sapiens
uggggcaaugaacauuuuugcaugcauaccaggaugaggcauggaaugaaguuuucuguugcccca

SEQ ID NO: 2243080 - RNA, 76 nt, Homo sapiens
caucccagagacagaaugauaaacuguugucagcagccgaggaagacagaccccaguuuacacugcuuugagggug

SEQ ID NO: 2243081 - RNA, 77 nt, Homo sapiens
ccuggaaauucuccagggguuuccccagaucagcagguagguaacgcugacucgugagguccccaggaggcaacagg

SEQ ID NO: 2243082 - RNA, 82 nt, Homo sapiens
gguagacacacauuucucaaaaaugcucaaggauacuaaaaaugauaccugaucucaugauugacgagaguaguagucuacc

SEQ ID NO: 2243083 - RNA, 111 nt, Homo sapiens
ggcgcucaccuauuucuugucgguccacaugguucugcccguggguuuucuaaucucacugcucauaagcaagcuugcugggccugacucaugaaggaguggcuugaugcu

SEQ ID NO: 2243084 - RNA, 59 nt, Homo sapiens
gggaguagagaguuucucugaccccaugugaugggaaaggacacagcuuuuuuacuucc

SEQ ID NO: 2243085 - RNA, 80 nt, Homo sapiens
gcuauaaagaacuaccugaguuuuauagucucagguaguucuuuauaccugagacugauugacucacaauuccacauggc

SEQ ID NO: 2243086 - RNA, 130 nt, Homo sapiens
uuuuuuuuuuuuugcuaucuggauaguugacauuggacuucauguuucuauuagcucacggaaggaggccugugggaucagucuggaauauugauuccuguggggguguaugggugcaagaaaaggagag

SEQ ID NO: 2243087 - RNA, 130 nt, Homo sapiens
caggcuggagugcgauggugcgaucucggcucacugaaaccuccgccuucuggguugggagagaggaucacuuggguccgggagguggagguugcagugagcugagauugcaccacugcacuccagccug

SEQ ID NO: 2243088 - RNA, 81 nt, Homo sapiens
gguccuuuguguggccuuggccuggcauugaccccugcuccugacccugguccugccauggcccuggcccugccaaugacc

SEQ ID NO: 2243089 - RNA, 76 nt, Homo sapiens
aaugagcugagguaaguaagaauggcaagcauauagacagaauuugcuauguuaaucuuauuuaccauuccucguu

SEQ ID NO: 2243090 - RNA, 75 nt, Homo sapiens
agugcaaaggucuaguaaggcaauagcaguguucucagucucuaucuauauuauuauuguccuucuauacccacu

SEQ ID NO: 2243091 - RNA, 72 nt, Homo sapiens
cacaaaggccauuuugucuuauuucagcauugaaagcuuguuaaugagaugaucaaaguauaggcuuuggug

SEQ ID NO: 2243092 - RNA, 85 nt, Homo sapiens
uggaguuuaccagaaauauuagcaaguccauauccauuugauauaaucaggaacugagauuguucuaugucugguuuccauucca

SEQ ID NO: 2243093 - RNA, 60 nt, Homo sapiens
gaccagugaauuuaaugagcaugagcccacugccacacaucuuuggugaguucuuugguc

SEQ ID NO: 2243094 - RNA, 56 nt, Homo sapiens
guugguucuguuuauaugauggauuauguuuauugauuugcauauguugaaccagc

SEQ ID NO: 2243095 - RNA, 96 nt, Homo sapiens
auguggagucugugguuguuugacauuaccaucauucccuacuuugaauuuauaugcuacugauaagcaaucauuuucuuacauuuauucacacau

SEQ ID NO: 2243096 - RNA, 73 nt, Homo sapiens
uguguucaaaguaaagccucaggauggauucaaaagggaagagaauugauaagagggauacuuuagaaauaca

SEQ ID NO: 2243097 - RNA, 63 nt, Homo sapiens
ggagucugugcauucuuaaaucaggaacuuaagucaguucuuguaacauaauguauguacucc

SEQ ID NO: 2243098 - RNA, 59 nt, Homo sapiens
uuugccucuuaaaauguucuggcauuugugcugauguugcagggcaaugaggagguaaa

SEQ ID NO: 2243099 - RNA, 99 nt, Homo sapiens
uucaaagcucucuuucagccgggugagguggcuuguuccuguaaucccagcacuuaugggaggccgaggcaggccaucgcuugagcccaggagcuugag

SEQ ID NO: 2243100 - RNA, 83 nt, Homo sapiens
ucucuugagcccaagaguuugaggcugcagugagcugugacuguacuacugcacuccaggcucaccugggcaacagaacgaga

SEQ ID NO: 2243101 - RNA, 59 nt, Homo sapiens
caggacaguuggcaucugcugcuucaugaauuguuuguagcagaguggcagcucuuuug

SEQ ID NO: 2243102 - RNA, 64 nt, Homo sapiens
uucaguuugccaguauuuuguugagaauuuuugcgucaguguucaucagggauauuggccugaa

SEQ ID NO: 2243103 - RNA, 79 nt, Homo sapiens
gaugaaguaacaacauucuaacugacggcuuuguuucucugcuaggcuuuccugggguuugauguaugcuggcuucauc

SEQ ID NO: 2243104 - RNA, 96 nt, Homo sapiens
ugguagagggcagagggaugagggggaaaguucuauaguccugagaucuaauuacaggacuauagaacuuucccccucaucccucuacccuuacca

SEQ ID NO: 2243105 - RNA, 64 nt, Homo sapiens
ucagaacuuguguugcuucacauguacguuauuuuaaugauaaaugguaaaagacaaguccuga

SEQ ID NO: 2243106 - RNA, 120 nt, Homo sapiens
ggauguuacuccuaaugucacagggauguacacccugugauauuauucauagugugccagagggauauuagcacuaaugucacgaugcguguacaccuugugauauuauuugucauaucc

SEQ ID NO: 2243107 - RNA, 66 nt, Homo sapiens
augaaaacuuuggcagggccuauguccagaaugguauuuccuagguugucuucccagaguuuuuau

SEQ ID NO: 2243108 - RNA, 73 nt, Homo sapiens
ucauguagguccuaacuaagaauuuuaaaauucuguuuuuuugauagucuuugcuggugaccuuccaauauga

SEQ ID NO: 2243109 - RNA, 55 nt, Homo sapiens
uugagguggugucuugcucuguuacccaggcuggagugcagugucgccaucucag

SEQ ID NO: 2243110 - RNA, 57 nt, Homo sapiens
gauggcauugaagaguugucccuacuggugugagggagcugggccuucacugucauc

SEQ ID NO: 2243111 - RNA, 63 nt, Homo sapiens
guaguuuaucagaaagaauagggccaaaauguagcuuauacuauuucuuuuuggaugggcuau

SEQ ID NO: 2243112 - RNA, 64 nt, Homo sapiens
gggaacuuaguaucuuacucuucucagcaagggaguuagcugagaaugacugggcaugcugccu

SEQ ID NO: 2243113 - RNA, 59 nt, Homo sapiens
uuuccacuuuguuauggggauauauguauuauuauuuaucucaaugcacagagaggaaa

SEQ ID NO: 2243114 - RNA, 79 nt, Homo sapiens
auuucuucugacaggaaacaugcagugauuaauaaaagcgccuccuugagcacugauuuauuuuugucucugaaggaau

SEQ ID NO: 2243115 - RNA, 78 nt, Homo sapiens
cuguauuuacacaaaccuagagguagccuacuacacaccuagaauaauaggguauagccuguugcuucuaggcuacag

SEQ ID NO: 2243116 - RNA, 55 nt, Homo sapiens
auggcauacaaaguggauaugaagaaauaaaauuauaucuacuugcaaaugccau

SEQ ID NO: 2243117 - RNA, 83 nt, Homo sapiens
uagugguuccuuuuaguggacaaagguauuuagaaaccaagaucuagaugccaguuguguucacugcuacagggguaucacug

SEQ ID NO: 2243118 - RNA, 64 nt, Homo sapiens
cuucaagaaugugcuguuggcugggcgugguggcucaugccuguaaucccagcacuuugggagg

SEQ ID NO: 2243119 - RNA, 60 nt, Homo sapiens
gugcacguguuugcaugugacuuaccccgaagcuugguaggcuuuuggagaacacugcac

SEQ ID NO: 2243120 - RNA, 56 nt, Homo sapiens
uugagauggagucuugcucuuguugcccaggcuggagugcaauggcuugaucucgg

SEQ ID NO: 2243121 - RNA, 82 nt, Homo sapiens
gagcauugaaguuguggaaugcuguagguuuuagcacuuauuuuuaaauugcagguucuuacagucaaguuacauuucucuc

SEQ ID NO: 2243122 - RNA, 71 nt, Homo sapiens
aagagccauggagaaaacagcuaucuaacuccgcucagguaaaaaaaggacuagcugcuuucuuggcucuu

SEQ ID NO: 2243123 - RNA, 65 nt, Homo sapiens
ucugagaauuagucuuuguauuuaaauauaauagauuugugauuaagcaacggcugcuuuucaga

SEQ ID NO: 2243124 - RNA, 66 nt, Homo sapiens
gugaauaaaacaccugccaagacgugguaggauuuaaaagugauuuggggcggguguuuuauucac

SEQ ID NO: 2243125 - RNA, 128 nt, Homo sapiens
ggagcaaaggauguuguagcuggggcaaaggauguuguagcuggggcagggauccucugagcagccuuuagugcaggguuucucaaccuccacacuacaauauugugggccagauaauucuuuguucc

SEQ ID NO: 2243126 - RNA, 93 nt, Homo sapiens
uuuauuuuaucuguaaaaggaaggcauaggacucaaugaucuuuaaggucccuuagagaucuuauauuuuaugacucaacauggugaaaugaa

SEQ ID NO: 2243127 - RNA, 63 nt, Homo sapiens
ggcccugagacaggaaaaagcuuggcaggaucuaagaaccaagcauuuuggugcuccagggcc

SEQ ID NO: 2243128 - RNA, 75 nt, Homo sapiens
agugugugacaguuuggugaggaagacgauauuuauauagucuugucucuccaucuauuagucuguucacacacu

SEQ ID NO: 2243129 - RNA, 55 nt, Homo sapiens
cuggaauucaaaaucugaauuuugccccacucugcauuucugguuuugguuccag

SEQ ID NO: 2243130 - RNA, 56 nt, Homo sapiens
cugugcacacacuuggcauuugcuuuuuguaugcagaugucagaguguggguacgg

SEQ ID NO: 2243131 - RNA, 63 nt, Homo sapiens
ugauuuaaaguguaugggaggaugugcauagguuauaugcaaaugcuaugccauuuuauauca

SEQ ID NO: 2243132 - RNA, 57 nt, Homo sapiens
gguugcagugaggugcagugauuggccagccuggaucacaugcacaucucuggaacc

SEQ ID NO: 2243133 - RNA, 64 nt, Homo sapiens
uucaguuugccaguauuuuauugaagauuuuugcaucaauuuucaucagggauauuggccugaa

SEQ ID NO: 2243134 - RNA, 67 nt, Homo sapiens
uugagccuaugugugucuuugcauugugagaugggucuccucaauacagcacacagaugggucuuga

SEQ ID NO: 2243135 - RNA, 71 nt, Homo sapiens
gugaucucagcucacuggaaccuccgccuccucaauucuccugccucagccucccgaguagcugggauuac

SEQ ID NO: 2243136 - RNA, 67 nt, Homo sapiens
agauagaaguaggcuacgugucugguauagaguagugaaucagacacccugccugcaaguuccaucu

SEQ ID NO: 2243137 - RNA, 103 nt, Homo sapiens
cugaggcaggagaaucacuugagcuugggagguggaguuugcagugagcugagaucaugccacugcacuccaaccuggacaacagagugagacucugucucag

SEQ ID NO: 2243138 - RNA, 68 nt, Homo sapiens
uggagaucaaugggauggaauugagaguccagaaauaaacccucauauuuauggccuauugauuuuua

SEQ ID NO: 2243139 - RNA, 57 nt, Homo sapiens
uucagagugguaugaagugaugauguagauauuugucauuccauuuccagcucugaa

SEQ ID NO: 2243140 - RNA, 78 nt, Homo sapiens
uaaacaauacacacagaugguguuggcugaguguauuagcuuugcuaucauacacucucauauuaucugaauuguuua

SEQ ID NO: 2243141 - RNA, 93 nt, Homo sapiens
uaggggguguuaacuggguacccuuuaaacaggaaaguccccaugaugucauuucuggauuaaaagguaugcauauguaauugacauuucuug

SEQ ID NO: 2243142 - RNA, 100 nt, Homo sapiens
gaggcaggagaaucgcuugaacccgggagguggagauugcagugagccaagaucaugccauugcacuccagccuuggggagaagagugagacuucgccuc

SEQ ID NO: 2243143 - RNA, 58 nt, Homo sapiens
ugagacugagucucacucugucacccaggcuggagugcaguggugcgaucucagcuca

SEQ ID NO: 2243144 - RNA, 65 nt, Homo sapiens
cagaugagaguggccaggguucauggucaugcucacauccucccuggacacacacuuuuauucug

SEQ ID NO: 2243145 - RNA, 76 nt, Homo sapiens
caauaugcuguuuugaauucucuagaacuuuguugcuccaaaaucaaauaucuucagauaaagggagaguauguug

SEQ ID NO: 2243146 - RNA, 81 nt, Homo sapiens
gaagaauguguauagcagugacaugugccaguuuauggugaaugccauaaaauuucucacaugugauuuuccauguucuuu

SEQ ID NO: 2243147 - RNA, 65 nt, Homo sapiens
cacaaagaguuuguagaaacuccauaguacucaaaagguuacaaguggguuugugcaggagugug

SEQ ID NO: 2243148 - RNA, 70 nt, Homo sapiens
guucugucccucuagagaaccauaacuauuacagacuuugguaccaggagugguucuagagaaacagaau

SEQ ID NO: 2243149 - RNA, 92 nt, Homo sapiens
cuggaauugugucuguccguuagaucacaguaccguaaggcugucacuuucugauuuuuauaauuguacugugauccagagauucuucuuag

SEQ ID NO: 2243150 - RNA, 72 nt, Homo sapiens
augguauuucuaguucuagauccuugaggaaucaccacacugucuuccacaaugguugaacuaguuuaccgu

SEQ ID NO: 2243151 - RNA, 67 nt, Homo sapiens
uuugaaaauuaucgggcuuugauuucuguuagcuuuuccugggaagcugucaaagucgguauucaaa

SEQ ID NO: 2243152 - RNA, 87 nt, Homo sapiens
caauguguuuuauggcuaugacucagaaggcacacacaguuguuucugugauguccuuuuggugucacaagucagcgcuauucauug

SEQ ID NO: 2243153 - RNA, 78 nt, Homo sapiens
gaguuuuuguacuucauacaauaacuccaugauuucucuuuguuauuuaaugggguuucccuaagagguuaagaacuc

SEQ ID NO: 2243154 - RNA, 112 nt, Homo sapiens
agugucacgaugggcuugacuagugaguuguuucacaauuaauaaaguacuaucuaucucuugccaaugagacaaucucaucucagugacaagcccagcaaaagaugauacu

SEQ ID NO: 2243155 - RNA, 70 nt, Homo sapiens
guauuucuaguucuagauccuugaggaaucaccacacugucuuccacaaugguugaacuagcuuuuaugc

SEQ ID NO: 2243156 - RNA, 57 nt, Homo sapiens
gaaccaugaccuugggagaauagaauguuucucuucucugggacauaggucggguuc

SEQ ID NO: 2243157 - RNA, 83 nt, Homo sapiens
gcuuaccuuaaaacagaccaugugauguuucuguaaaugguucuggucauugauaugugaguauaugguuauuuguggugagc

SEQ ID NO: 2243158 - RNA, 88 nt, Homo sapiens
ggagaaucacuugaacccaggaggcagagguuguggugagccgagaucacgccauuacacuccagccugggugacagagugagacucu

SEQ ID NO: 2243159 - RNA, 58 nt, Homo sapiens
cucacacugucuucauuacuguagcuuuguaauaggcuauaaaaucaggcagugugag

SEQ ID NO: 2243160 - RNA, 104 nt, Homo sapiens
gaguauauacugcaugacuccauuuaucugaaauuuuauaauagucuaaacuaaucuaggaugauaggaaucagaaaagugguugucugugaggugugugauuc

SEQ ID NO: 2243161 - RNA, 76 nt, Homo sapiens
gggugacugggggccuugugggagugucugggggguggccccucccaucacgugcaguggccccacagggaaaccc

SEQ ID NO: 2243162 - RNA, 60 nt, Homo sapiens
ugggugugaccgcucaagggggcuucuggggaggccccuucuggaggugaucgcugcuca

SEQ ID NO: 2243163 - RNA, 55 nt, Homo sapiens
uccuaaaugggagacggcauggucacaugugaaccaaaugcuguaauguuuggga

SEQ ID NO: 2243164 - RNA, 66 nt, Homo sapiens
guuaagaauguuauugcuuuagagcuucuuuugggguauuccugaaguaauaaauggauucuuaac

SEQ ID NO: 2243165 - RNA, 73 nt, Homo sapiens
ggucucugcucgucuaauauugguguguaggaaugcuugcaauuuuugcacauugauuuuguauccugagacu

SEQ ID NO: 2243166 - RNA, 62 nt, Homo sapiens
cagacuaugccucaaucacuugucaucaugguagugaugacaagugauuaaggcauauucug

SEQ ID NO: 2243167 - RNA, 70 nt, Homo sapiens
uccagaaaccaugacugcucugggcucccaugacaucucauggguuuucucaaguagucaccuuuuugga

SEQ ID NO: 2243168 - RNA, 57 nt, Homo sapiens
auuccuggauuccucaccuggacauuauuaaguaggucugugguagggaccaggaau

SEQ ID NO: 2243169 - RNA, 90 nt, Homo sapiens
acuggcauuuucuucagugauacugcuuauuaauuuaauuugcuuuuaauuugaauuggcucuaggugucacagauuuugaaguuucagu

SEQ ID NO: 2243170 - RNA, 61 nt, Homo sapiens
gaggacuuggaaaaugggagcugguuuuauaauaauuaccccgagacugccaagaauccuc

SEQ ID NO: 2243171 - RNA, 55 nt, Homo sapiens
guaauaacuguggaaaaagguuuuugcagucgcuuaucugugccacuguuauuac

SEQ ID NO: 2243172 - RNA, 56 nt, Homo sapiens
guggacggagguugcagugagcugagauugcgagacugugcugcagccugguccac

SEQ ID NO: 2243173 - RNA, 59 nt, Homo sapiens
ggcaaguugcuuaaccucuccagaccuauaagaggaagagguuuaaucaggcaguugcu

SEQ ID NO: 2243174 - RNA, 101 nt, Homo sapiens
ugaggcaggagaaucgcuugaacccgggaggcagagguuguagugagccaagauuaugccacugcacuccagccucggugacggagugagacuccaucuca

SEQ ID NO: 2243175 - RNA, 69 nt, Homo sapiens
ucuuucuagcagugcaagaacagacuacuacagaaaauugguaccaggagugguguauugcuaaaaaga

SEQ ID NO: 2243176 - RNA, 62 nt, Homo sapiens
uauuuagaugauauccacuuuuuaaagacuagagugucuuugagugugauaucgauuggaua

SEQ ID NO: 2243177 - RNA, 98 nt, Homo sapiens
accaccaaagccuccacagccuuagcccagaccucuguaauaguuaccuuaguaauucacgagguuaggaguuaaaggcuugguuugcuauugauggu

SEQ ID NO: 2243178 - RNA, 73 nt, Homo sapiens
aggcucuuuuguuuagcugagagggcagugagccacccccuuccuucucucugaggucuggacaagagcgcuu

SEQ ID NO: 2243179 - RNA, 82 nt, Homo sapiens
guggauacugagcaagcggcauuccaggaauuaauuuucuugaaaagaucccugguguuaguuuguucuuuugguaauuugc

SEQ ID NO: 2243180 - RNA, 83 nt, Homo sapiens
gggaucuggugagcuagaccacuuggcucccuggcuucagccccuuuccaggggagugaaugguucugucucgcuggcauucc

SEQ ID NO: 2243181 - RNA, 60 nt, Homo sapiens
ugugaauggugcugccgugaagauaggcaugcuugugucuucaugguagaacuauuuaua

SEQ ID NO: 2243182 - RNA, 79 nt, Homo sapiens
cuguuuaaaucugccauucugaucuaaugaaucuacagucacuauuuagauuauuggcugauuugauccaccugugcag

SEQ ID NO: 2243183 - RNA, 64 nt, Homo sapiens
cuugcucaacaucagagaguucacacgggagagaaacccuaugaauguaucgaaugugggaaag

SEQ ID NO: 2243184 - RNA, 55 nt, Homo sapiens
ccugaagauuagaaggagugcaccuucucaaggugccuacuuugcaucugucagg

SEQ ID NO: 2243185 - RNA, 63 nt, Homo sapiens
cuguaccgcagugacauuccuugauacuugucauggugauccagugagugcagcuguugucag

SEQ ID NO: 2243186 - RNA, 56 nt, Homo sapiens
ugguaucauuuuaucugcucuaugucagguacagagaggagacgaggagugaacca

SEQ ID NO: 2243187 - RNA, 62 nt, Homo sapiens
ucugugaaucugggaacacaauuaagcuacuaauauuuguuaauuguccuugauuacacaga

SEQ ID NO: 2243188 - RNA, 89 nt, Homo sapiens
ccccauaugugugaguaacuuaaguauagguaacagaagcaaacugguggguuugguauucuaguuaugauauucucgcuuuuaugggg

SEQ ID NO: 2243189 - RNA, 71 nt, Homo sapiens
acuggucauggcuuuugaccugguaggaugacccaaaguuucauuccugaagagucuaggcgauuacuagu

SEQ ID NO: 2243190 - RNA, 60 nt, Homo sapiens
uggcaagaccccaucucuacaaaaaacugaaaaauuagcugggagugguggucugugcca

SEQ ID NO: 2243191 - RNA, 84 nt, Homo sapiens
ucuuuaagcgaggaaaauuugugacgaccuuguauguuauuuagaguucuaaauguugcacagugcuuucuuugccccagaaga

SEQ ID NO: 2243192 - RNA, 65 nt, Homo sapiens
uuuauaacucugcagccugguauuucacauuugcagauggggagaccgaggcucagagaggugaa

SEQ ID NO: 2243193 - RNA, 69 nt, Homo sapiens
gcagggcugcugcacugagacaccuggcgccuaggcccuccccaggccuuuugugcaugugcagccugc

SEQ ID NO: 2243194 - RNA, 70 nt, Homo sapiens
cucaagguagucaagugggguuagauaguuuuucaagaagaacgaaggaaagugcaugacuaucauuggg

SEQ ID NO: 2243195 - RNA, 59 nt, Homo sapiens
acaugggagugugguuagagaccugggcacuuugcccagcucuguaacccauucccugu

SEQ ID NO: 2243196 - RNA, 62 nt, Homo sapiens
gagacauugagaguuucgcugggauuaagaccacauggacuuaacagcuccacuccauucuc

SEQ ID NO: 2243197 - RNA, 71 nt, Homo sapiens
ugguguugcuguuuucaaggcauucugggagaaacaccuucacaguugauugaaacacagcugccacacca

SEQ ID NO: 2243198 - RNA, 56 nt, Homo sapiens
ugaguagucagugggcaggaaggggaguuuuuaccuuccucugcaacugaugcuca

SEQ ID NO: 2243199 - RNA, 130 nt, Homo sapiens
auucagagagaaaagaauccucuucccaauagaugguguugggcccauagacugccaguauugggucaauagacugucaguauuggcccaacaccaucuacugggaagaggauucuuuucuucuuugaau

SEQ ID NO: 2243200 - RNA, 78 nt, Homo sapiens
uguucuuuuugcuuaggauuauuuggcuauuugggaucuuuuuuguuccagcuuuuucuaauucugugcaaaaugaca

SEQ ID NO: 2243201 - RNA, 75 nt, Homo sapiens
cucccgcagcagguccgagacuaagcugucauggcugagacuaugagcacuuguuuugggcacagaauugaggag

SEQ ID NO: 2243202 - RNA, 68 nt, Homo sapiens
cuugaacccggaggcgggggaugcagugagccgagauugugccauugcacuccagccugggugacaag

SEQ ID NO: 2243203 - RNA, 94 nt, Homo sapiens
gcagucagagggcagagaaaggcagggaccuucaguugcacaggaaggucugcaucuggguccguucugcuucucacugcacauguggccuugc

SEQ ID NO: 2243204 - RNA, 76 nt, Homo sapiens
uauaauuugucagcuuucaaggugaugcaaguauuaaaucauauacuucuguaaacuaugagcugauuauuuuaua

SEQ ID NO: 2243205 - RNA, 56 nt, Homo sapiens
gcaauggaaucccuugaucaauuuucuaugcaauaugauuaaacugguuccauugu

SEQ ID NO: 2243206 - RNA, 103 nt, Homo sapiens
cugaggcaggagaaucacuugaagccaggagauggagguugcagugagcagagaucgcgccauugcacucuaucccggugggcagugcgagacuccaucucag

SEQ ID NO: 2243207 - RNA, 63 nt, Homo sapiens
auuuucacuguauuguggaagaauacagaaagaagaaacacuuuucuacagucacaggaagau

SEQ ID NO: 2243208 - RNA, 61 nt, Homo sapiens
aagagauggcucuuucuagacuuaauuauaagcuuaguaguccauuggagagucaauucuu

SEQ ID NO: 2243209 - RNA, 130 nt, Homo sapiens
ucacuccagaaauacuauaauagucaaaaguacgaauaaagcuauuccucucuuuuuauggcaguaaaauagaaagagaugaaugcuuuaaguguaauucugccugugguuucaguaguuuuggacagga

SEQ ID NO: 2243210 - RNA, 82 nt, Homo sapiens
gcccuaaugucccugaggcuagacuuugagaauuuuuuacaagagugaaaauuucaaaauaguuuagcaagugaccuaaggc

SEQ ID NO: 2243211 - RNA, 89 nt, Homo sapiens
ggaguuucaaucuuguugccuaggcuggaaugcaauggcguggucucagcucauugcaaccuccaccucccagguucaggugauucuuc

SEQ ID NO: 2243212 - RNA, 67 nt, Homo sapiens
ggauuacaauuuuuuggaagaguaaaaaguucacacuuuugaaauuucacagaaggauuguagggcc

SEQ ID NO: 2243213 - RNA, 90 nt, Homo sapiens
caggcaagaaggggcugggugaggaaugaccccgugugguccuauggccauguccccauuccuucacucccuaagaccguucuugcucug

SEQ ID NO: 2243214 - RNA, 79 nt, Homo sapiens
gaacaucuuuuacugugacugcauauaaguguauguuuacauaaacauacauagagguguauuacaucaaugaauguuu

SEQ ID NO: 2243215 - RNA, 55 nt, Homo sapiens
gauuagucgugacugccugaaucaaggguuggaucagguagugccaugauugauu

SEQ ID NO: 2243216 - RNA, 58 nt, Homo sapiens
cccgggaggcugagcuugcagugagcggagaucgcgccacugcacuccagucucuggg

SEQ ID NO: 2243217 - RNA, 60 nt, Homo sapiens
aaacuucugccugaacauccaagcauuuccuuacauccucuggaaucuaggcggagguuu

SEQ ID NO: 2243218 - RNA, 87 nt, Homo sapiens
cugcagagagacuuggcagugguucugacggaccugugaguccacaauaggaaacggucuucaugaccauagcuaaguaccauguag

SEQ ID NO: 2243219 - RNA, 57 nt, Homo sapiens
ggcuauugaugagaucucugcacuccuauuuuuauugcagcacuguucacaauagcc

SEQ ID NO: 2243220 - RNA, 64 nt, Homo sapiens
uuuucuggauugccuuuucaguguuaagucuaagaacuuuuugcugagaccuagauccuaaaga

SEQ ID NO: 2243221 - RNA, 68 nt, Homo sapiens
ccccauguagagcuaguugcucacugcuuuuggcugcucucugggcagcgggaugacuaguugugggg

SEQ ID NO: 2243222 - RNA, 99 nt, Homo sapiens
acaaagaaguuuugacauuuaggaaucauacacacagcuuaaaagacccaguugcuuuuaccacaggcauguguggguuauuaaagaauccuucucugu

SEQ ID NO: 2243223 - RNA, 60 nt, Homo sapiens
agggcgaaagaaauagcuauaaacuguaaccaaacauucacuaagcuguuguuuuguccu

SEQ ID NO: 2243224 - RNA, 57 nt, Homo sapiens
ccagccuggacacugcucaugcucuccccugagggaaguggguaguuuucuggcugg

SEQ ID NO: 2243225 - RNA, 68 nt, Homo sapiens
ugcaguuuaggaacugguaacauugauuucuacucuauuuaccagcguuucuaauuggaaaagcugca

SEQ ID NO: 2243226 - RNA, 79 nt, Homo sapiens
ucuaaucaguugcaagucuugaguaaagacugagguuccccaaagaaaaaggaauucuuccucgagacugcaauguaga

SEQ ID NO: 2243227 - RNA, 58 nt, Homo sapiens
uuaaagaugcugggaaggcuaggcaagguggcuuguaccuguaaucccagcacuuugg

SEQ ID NO: 2243228 - RNA, 73 nt, Homo sapiens
gcuguuguguuauggaagcuaugccagcuggcaccuuucuugguucagugccucaguuuuuaaagaugacagc

SEQ ID NO: 2243229 - RNA, 68 nt, Homo sapiens
ugccuuguuuauauguucugagauuauagucauauguuuauguguucugagauuauauuaacauggua

SEQ ID NO: 2243230 - RNA, 129 nt, Homo sapiens
uuauuauauagguaaacuguaucauggagguauggacuacagauuauuucaucagccacauaauaagcaaaauacucgagagguaguuuuuuggucgucucccuccugccacacuccacccucaaguag

SEQ ID NO: 2243231 - RNA, 85 nt, Homo sapiens
gagaauugcuugaaccugagaggcggagguugcagugagccgagaucgcgccauugcacuccagccucggcaacgagcaaaauuc

SEQ ID NO: 2243232 - RNA, 90 nt, Homo sapiens
gggaggcuggaucccugcagaaacggcuuugaggguaguucuuucagcaaguacaccaugucuguuucugguuuggcuuuucaguuuccu

SEQ ID NO: 2243233 - RNA, 71 nt, Homo sapiens
uauaaggcugguauagacauucauguagaaaacaaaauacuaaauuugacugucauauagccugccucaug

SEQ ID NO: 2243234 - RNA, 74 nt, Homo sapiens
uuacuuuuugcuccuggcaaacucauaagagggaaaguaaacccugcuguggucuggaauaggacaaagaguga

SEQ ID NO: 2243235 - RNA, 66 nt, Homo sapiens
gaagcuggucugggccagguccucuccuguacauggucaggugaugacacuguccuugaccauuuc

SEQ ID NO: 2243236 - RNA, 97 nt, Homo sapiens
gucccuugaauguugccaagacauauuucaacgcuuucccuuuuaaugauucaguuguugaaaucaucacuuggcaugcaaauaauauuuauggggc

SEQ ID NO: 2243237 - RNA, 101 nt, Homo sapiens
aguuuauucuuucaugugcauuuuagaaaaucagcgugucaaauccuucaaggguucuguuuggauuuggcagcugcuucaugggaugcgaagguuaaacu

SEQ ID NO: 2243238 - RNA, 98 nt, Homo sapiens
gaggaaggagaaucgcuugaacccgggaggcagaacuugcagugagccgagauggcgcuacugcacuucagccuugugacagagcgagacuccgucuc

SEQ ID NO: 2243239 - RNA, 83 nt, Homo sapiens
auuccaaauguaaaaaauucagucucaucugagacaaggccacagucccuucugucuaugagucccugaauuuaaaacggagu

SEQ ID NO: 2243240 - RNA, 95 nt, Homo sapiens
uggggaaacagaggcuggggcugggugagggggugggaagcagggagccuuccacugcuauguuuucccuccuuaucuagggcucuguccuccca

SEQ ID NO: 2243241 - RNA, 59 nt, Homo sapiens
gacagccagauuguccaguuuuuuauuauuaauaagaaggaauuugcaaucuguuuguc

SEQ ID NO: 2243242 - RNA, 70 nt, Homo sapiens
aggguaaggaguagaauaguaaggcaguaauuaaugaguauuuugugccuggccaacuucuacuuacccu

SEQ ID NO: 2243243 - RNA, 98 nt, Homo sapiens
aagaagacagagcuaguaaguauuaggugugagauucaaacauuauuguuccagcuccagaguccauacucuuaaucucuacucuguauugucuuuuu

SEQ ID NO: 2243244 - RNA, 58 nt, Homo sapiens
uucuugcacugaucccauaagcauuaguccuauauguuguuguguuaucaguuaagga

SEQ ID NO: 2243245 - RNA, 73 nt, Homo sapiens
guugcugucuuugguucuguuuauaugcuggauuacauuuauugauuuguguauauugaaccaggguugcauc

SEQ ID NO: 2243246 - RNA, 130 nt, Homo sapiens
gcucauauccaucugugugaguucauaucugugagugugcauucaugccugugugagcucaugucugugugaguucauaucuaugagugugcauucaugccuguaggaacgcaugucugugugugugagu

SEQ ID NO: 2243247 - RNA, 69 nt, Homo sapiens
ggaacccauucuuuuagcucugcaaggaaagcuagacuugggcuuuccauuguuggagcauaaaguucc

SEQ ID NO: 2243248 - RNA, 65 nt, Homo sapiens
gucauaugcucggaaaauguuaacugaaaguauaauuauucugauuaauuuuucugggcauagac

SEQ ID NO: 2243249 - RNA, 64 nt, Homo sapiens
uugcuuuuugcuauuuugagucuauucugcagcauagagguauaccaaaaaggcaucugagcag

SEQ ID NO: 2243250 - RNA, 67 nt, Homo sapiens
auugccaagauuuaauucaucaguuagggauugggguuucagaacugguaauaaaauuguuugcagu

SEQ ID NO: 2243251 - RNA, 82 nt, Homo sapiens
aguaucuauuuuauguggcuguugugaggauuaaaugggcuaaucuacguaguacccuugaagcagacauagggugaauacu

SEQ ID NO: 2243252 - RNA, 96 nt, Homo sapiens
cuuggagacaaugaggugcagaggaaaugagugaguguuuuuacgucacagucacugcucuucuaaaaaguuucuaaugcaccucgauauucuagg

SEQ ID NO: 2243253 - RNA, 93 nt, Homo sapiens
gagaauugcuugaacccgggaggcagaaguugcagugagccaagaucgcucuacugcacuccagccugcccaacgggagcaagauucccucuc

SEQ ID NO: 2243254 - RNA, 79 nt, Homo sapiens
cuuagaaaucuuugauugaagggacccugggaagcacagaauugaagcuucuaggggacugacaagcggggacucugag

SEQ ID NO: 2243255 - RNA, 73 nt, Homo sapiens
gccuggcggguuuugcuaccugcugauugcugagcccuagggggacuugagcaaacaaaggugguagccaggc

SEQ ID NO: 2243256 - RNA, 74 nt, Homo sapiens
ggucacuggucagugaaacaguauuuccuaaguaugucugacuuccacaauacuugaauuucaugucaggggcc

SEQ ID NO: 2243257 - RNA, 56 nt, Homo sapiens
uuuccuggcugugagucguacguaccguaguuacgugagaugcaaucaccagggag

SEQ ID NO: 2243258 - RNA, 102 nt, Homo sapiens
uuugacuuauauuaaggugaccuguuugaaauugccaauuuugugggucgaugacagcugaauauuggcaguuuuaaaugguucaaucuaaugcgaguuaaa

SEQ ID NO: 2243259 - RNA, 76 nt, Homo sapiens
cuauggaugccuuucuaggaauacacuuuccgggguuccuuuuuucccugagaugugaauuucagagcuuccaaag

SEQ ID NO: 2243260 - RNA, 106 nt, Homo sapiens
gcuuugagcagaaccuguacccgaacuggacagagagaccggcauuuuggaguccaggauucagauuucaugucauaaucgaagguccagguauccaugccagggu

SEQ ID NO: 2243261 - RNA, 97 nt, Homo sapiens
auggauaaaguacaucugucuaagaaaagagucuauaaacagauuguugaacuuuuuauuugucauagaugauuuuuuucggggggaguuuguuugu

SEQ ID NO: 2243262 - RNA, 58 nt, Homo sapiens
gucugcuaucuguggagauucacucagcugguuggugacagucucccgauggcuaggc

SEQ ID NO: 2243263 - RNA, 56 nt, Homo sapiens
agucacuguagagaaacagguuuccucugagguaaagcugguuuccacagugugcu

SEQ ID NO: 2243264 - RNA, 69 nt, Homo sapiens
ucccuguguuccuuuugaauugcugcugucaaauuaccacaaaugccguggcuuaaaaugacacaggga

SEQ ID NO: 2243265 - RNA, 123 nt, Homo sapiens
aagugagcugggucaaccaucaguuuggcuuucucucuauccugugguuuuuuuccccaucucagcaggaaguagaguuggccagccaugaugauaaacaaagaaggauucagcauuuuacuu

SEQ ID NO: 2243266 - RNA, 78 nt, Homo sapiens
ucugugugcacaugcgugcgcacauauguauguguauaugugcauguguguauguguauguguauaaacuaugacaga

SEQ ID NO: 2243267 - RNA, 61 nt, Homo sapiens
ucuguuuggcaugugcuggccaugugcaaacccacaauuauauuggccaauggcaaacaga

SEQ ID NO: 2243268 - RNA, 55 nt, Homo sapiens
aagaacagauuggagauaucgcugaaaaaaauucaguuucucuuuaguuuuucuu

SEQ ID NO: 2243269 - RNA, 99 nt, Homo sapiens
gaggcaggagaauggccccaaaccgggaggcggagcuugcagugagccgagaucgcgccacugcacuccagccuggcggacagggccagacuccgucuc

SEQ ID NO: 2243270 - RNA, 75 nt, Homo sapiens
uccugcgguuugcaugggagcugggugaggccugugacugccggcuuuccccgacuucccugacaaccugcauga

SEQ ID NO: 2243271 - RNA, 66 nt, Homo sapiens
cuuuugacuacugaugguguacgcgugcccuggcagggauggccauugugcugucaguaucaaggg

SEQ ID NO: 2243272 - RNA, 83 nt, Homo sapiens
auuagaugagauauuuuauaagaucauuuuagagguggacuuuguucauguauacguguuuuaugauaaauaucuugccuagu

SEQ ID NO: 2243273 - RNA, 67 nt, Homo sapiens
acauagaugcuggcaaucauguucaagauggcggcuccauuuucccuuugcuuugucagccaugugu

SEQ ID NO: 2243274 - RNA, 64 nt, Homo sapiens
auugugaauagugccguaauaaacauacaugugcaugugucuuuguaguagcaugauuuauaau

SEQ ID NO: 2243275 - RNA, 84 nt, Homo sapiens
guuguagccagagacugcauuugaugacguauggugaggccugcucuuaccuauauaaaucagauucagcucugugugcuagac

SEQ ID NO: 2243276 - RNA, 77 nt, Homo sapiens
uugauauaguuuuuccugggaggaaaguagaauacauaucuuugucuacauuucagagacuagaaaaaauuauuugg

SEQ ID NO: 2243277 - RNA, 88 nt, Homo sapiens
gcucaggccuguaaucucagcaccuguaaucucaggccuguaaucucggugaauugcuugagcacaggaguuugagaccagccugggc

SEQ ID NO: 2243278 - RNA, 64 nt, Homo sapiens
uuuuaagagauugguauuuuauuagauugugaccaaauuaacuguaaguacuugucuuuugaag

SEQ ID NO: 2243279 - RNA, 57 nt, Homo sapiens
gaacaggagaggcacccauggcgcagcucacagcauuccaucaguccucucuuguuc

SEQ ID NO: 2243280 - RNA, 64 nt, Homo sapiens
uguccucuuccaaguugcagauggccaucuucucauuguaucaucacauagaggaaagaggaca

SEQ ID NO: 2243281 - RNA, 113 nt, Homo sapiens
gccucucuuucaguaugugaaagugcuaagagguauuucaaaacaacccaugggauuagcaugcccacuggcuguuaggaauuaccuccguuuuacauuagagaaaugaaggc

SEQ ID NO: 2243282 - RNA, 55 nt, Homo sapiens
cagcugguggcaagaagacagaaguccuccuacaacuaucucuuggcacucgcug

SEQ ID NO: 2243283 - RNA, 75 nt, Homo sapiens
ucgcucugucgccuggcuggagugcaguggcgugaccucggcucacugcauccucugccuggcggguucaaguga

SEQ ID NO: 2243284 - RNA, 101 nt, Homo sapiens
aaaaugaaacuggaguuuuguaguguggaaauugccacugguucagagucuuuugcuuuuggcuuuuccaggcauuacgauuuggcaccaacuuuuauuuu

SEQ ID NO: 2243285 - RNA, 86 nt, Homo sapiens
uuuccagagguccuauggagugauacaguuuacauuccagagguccuauggagugauaucacuguaucacuccauaggacuggaga

SEQ ID NO: 2243286 - RNA, 55 nt, Homo sapiens
gucacuucccggggucucugaguccccucugcacucagaagcucccagggaggac

SEQ ID NO: 2243287 - RNA, 99 nt, Homo sapiens
gagguaguuaggaaagggacugggccauauugauaauggaagauugauaguaaaaucauagaaguguguuaacauggucucagucuguuucuguaucuc

SEQ ID NO: 2243288 - RNA, 85 nt, Homo sapiens
ugccaguuuuccaagggaaugcuuccaguuuguguccauucaguaugauauuggcuguggguuucucuagaagaaaaccuaggca

SEQ ID NO: 2243289 - RNA, 66 nt, Homo sapiens
ugccuagaaacacuauuucuccuucauuucugaaguauaaauuuucuggguguaguauucuaggua

SEQ ID NO: 2243290 - RNA, 61 nt, Homo sapiens
ucaguaguuuuuuuacuaggugcuagucccuaauggaaucaggguagaauaaaacuauuga

SEQ ID NO: 2243291 - RNA, 89 nt, Homo sapiens
agaguuuuuaauuaugaagugauguugaauuuugccagaugcuuuuucugcaucuuuugagauaaucaugugauuucauccuuuauucu

SEQ ID NO: 2243292 - RNA, 55 nt, Homo sapiens
cuaggacugugcauggagagccacuguuuuaggucacggucaucacagucucugg

SEQ ID NO: 2243293 - RNA, 72 nt, Homo sapiens
gugauaaguaaaugugcaauuuguaggcagguccaggcaccuuugcuuaguuguauguuccacauaugucac

SEQ ID NO: 2243294 - RNA, 109 nt, Homo sapiens
uagaauuagagauacguaagugcuaaagauagugacaugauuugggaucugcuguuuucugggcaaaaacagauccgugucuuguuuuucuuauuuauuuucccuucua

SEQ ID NO: 2243295 - RNA, 90 nt, Homo sapiens
gugggcacagauggaguggaggccaaguucuuuuggugagauaguuuccugcuaagauucaucaguugagcugguugcuucaguucccac

SEQ ID NO: 2243296 - RNA, 69 nt, Homo sapiens
ccugguuaucacuguuguuuguuuaaggcuuuaggccucuacaaugagcaagugguaaaauaaaccagg

SEQ ID NO: 2243297 - RNA, 57 nt, Homo sapiens
augaucauggaagugcacccauugggguuauauaaggguugugugcuucaugaucau

SEQ ID NO: 2243298 - RNA, 58 nt, Homo sapiens
ucauggcauuguuaaggguuuuaaaugagauaauacaaguucuuagcauaaugccuga

SEQ ID NO: 2243299 - RNA, 68 nt, Homo sapiens
agggacuauauagauuagggucuguuucuggguucuauucaguuccauagaucuauuuauguaucccu

SEQ ID NO: 2243300 - RNA, 81 nt, Homo sapiens
uuguuuuuugagauggagucucgcucuguuguccaggcuguccaggcuggagugcaauggugagaucuuggcucacugcaa

SEQ ID NO: 2243301 - RNA, 62 nt, Homo sapiens
uugugaauagugcugcaauaaacauacaugugcaugugucuucauagcagcaugauuuauaa

SEQ ID NO: 2243302 - RNA, 92 nt, Homo sapiens
uucauacuuugguuagcucucuaaauucauuucagcucuggguaagguuaaauccuucucccaugauuuggauuuucagguuccccagugag

SEQ ID NO: 2243303 - RNA, 66 nt, Homo sapiens
uagcuucuccauagcuccauguugucauccaaacugaaccuacuugauauggagccuccuaagcua

SEQ ID NO: 2243304 - RNA, 56 nt, Homo sapiens
cugagguacccacuucaucucacuggaauugguuggauagugggugcagccuacag

SEQ ID NO: 2243305 - RNA, 62 nt, Homo sapiens
uccccccagguuucaauaaagcccagguuauugaagcuggguccuggaagagccugggagga

SEQ ID NO: 2243306 - RNA, 67 nt, Homo sapiens
uuuaaggcaugccuguacaugcucauacauuuuucuaaauauaaucuuaugugcaggaugcccugag

SEQ ID NO: 2243307 - RNA, 64 nt, Homo sapiens
cuagugcaguuccccugucuuaauaucagcucugucuaggcagcgggcaaggggaacccauugg

SEQ ID NO: 2243308 - RNA, 112 nt, Homo sapiens
gaccugugugggcaaucuccagggcaugugggucuauuggcaugcacgcauggguagccaagagucaaagcaaguuuugccaauggauucccaucaucuuugcaugcagguc

SEQ ID NO: 2243309 - RNA, 103 nt, Homo sapiens
gagaguaggagguuggacauugagauguuuagauuguugucucugugauagguuuugagagacucgggucuaagaugucuuucccauuagccugaauauucuc

SEQ ID NO: 2243310 - RNA, 60 nt, Homo sapiens
aaaaggguaacuaugugagaugauagauauguccauuuauugcacuaugguaacccuuuu

SEQ ID NO: 2243311 - RNA, 57 nt, Homo sapiens
agccacgaccuucuugggagcagugaggaaucuagccugacuccagaguugugugcu

SEQ ID NO: 2243312 - RNA, 63 nt, Homo sapiens
uauucugaaacuuugucagccguuuaucaguuccaugagccuauuggcagagucuuuagggua

SEQ ID NO: 2243313 - RNA, 72 nt, Homo sapiens
uuucuucuugaaugaccaaaauaauaaaagacucugugaggcucaugagauuuuuggucauucaggaagaaa

SEQ ID NO: 2243314 - RNA, 57 nt, Homo sapiens
guguugggauuacaggcaugagccacugcaccuggcccuauguaguuuucucaauau

SEQ ID NO: 2243315 - RNA, 127 nt, Homo sapiens
ggcacaaagcaaugaagacaugugagcaagcuucuuguucaugugcaugggaaucucaaguguuaccacuucauuuagaugauguuuacugagcaucaggagcaguauaugucagcaccaaugugcc

SEQ ID NO: 2243316 - RNA, 56 nt, Homo sapiens
guugguucuguuuauaugcuggauuauguuuauugauuugcauauguugaaccagc

SEQ ID NO: 2243317 - RNA, 97 nt, Homo sapiens
ggaagcagugaauucacaaggaagagugaauuaucuugacuggaaucaauacauacauugcagacauagauuuccuuuuccugucagugcugcuuuc

SEQ ID NO: 2243318 - RNA, 69 nt, Homo sapiens
agaaacaugagauuauguaaagagaccaaauuuauggcuguuugguuugacacauaaucaucagauucu

SEQ ID NO: 2243319 - RNA, 101 nt, Homo sapiens
auaguuaucguuaucucaauuuuuuaacaguugcaugagacugaggcccagagggguucguuaggaugcaagugucuaaagagggugaggacgcaugcugu

SEQ ID NO: 2243320 - RNA, 72 nt, Homo sapiens
gcucuuagccagagaaagggaguuuuggauaaacuaaagacuggaaugaugacuuuuugcugugcugggagc

SEQ ID NO: 2243321 - RNA, 89 nt, Homo sapiens
auaguuaauggcucagcuaugaaauggaccgucaugcaaugucuaagacauuugcaaagaccucuucacuuccauggagucauaauuau

SEQ ID NO: 2243322 - RNA, 85 nt, Homo sapiens
ugucugugguacccuacucuggagagugacaaucauguauaauuaaauuugauugacacuucugugaguagaguaacgcaugaca

SEQ ID NO: 2243323 - RNA, 58 nt, Homo sapiens
cuguuagggucaaccucaaagcugcccuuuucuuucugcugagguuagguucugacag

SEQ ID NO: 2243324 - RNA, 80 nt, Homo sapiens
ugaugaggugagggguuaggugcuauagguggccaaggaacagaaugaaacuaaugggauccaaagaccucaccucaucg

SEQ ID NO: 2243325 - RNA, 63 nt, Homo sapiens
ugggaagugugaguaggauuuggaacuugguguucacugauuccaaacaccuacucuuuucca

SEQ ID NO: 2243326 - RNA, 66 nt, Homo sapiens
uggguagguguggccugaauguugucaguuacccacuucuauaaauaucccagucacaucuaccca

SEQ ID NO: 2243327 - RNA, 73 nt, Homo sapiens
ugcgcgucggugugaagagaccaccaaacaggcuuugugugagcaacauggcuguuuauuucaccugggugca

SEQ ID NO: 2243328 - RNA, 85 nt, Homo sapiens
acaaauaagcugccacuguauucucugacagguucauugagcaggcuuguauguuguuugucagagaagcaggguuccauuuugu

SEQ ID NO: 2243329 - RNA, 62 nt, Homo sapiens
ggagugcauaugggccugugucacucugucugccuggagugaauauggcccugugucacucu

SEQ ID NO: 2243330 - RNA, 60 nt, Homo sapiens
gaguugagaaguugggaaagagaugguauacucacaucccuuugcacugcuccucagcuc

SEQ ID NO: 2243331 - RNA, 56 nt, Homo sapiens
aggaguuagaaaaguaccuccuuuuuacaaggaaggauggcauuucuuuagcuuuu

SEQ ID NO: 2243332 - RNA, 71 nt, Homo sapiens
gccggaaaugagcuauggagacagggccacgcaaggucaaagugagccuugagcuguagcuuggggccggc

SEQ ID NO: 2243333 - RNA, 77 nt, Homo sapiens
uuacaagaucagugguuuucucaguucagcagugcauggucuaguguugaauaggugaagcacaagagauuuuguag

SEQ ID NO: 2243334 - RNA, 87 nt, Homo sapiens
guggaaauagaaaaaccaagggaaugcgcugccuguguucuugcucgaguccugagagcacgagucggucugcuuuccccuuuccac

SEQ ID NO: 2243335 - RNA, 68 nt, Homo sapiens
caugaagguaguuuauagaugugguuagcaguugucugugacuguaagucuacagcugccuuucagug

SEQ ID NO: 2243336 - RNA, 98 nt, Homo sapiens
caucauuauuauuugcccuuccuuaccuuccucacagguuugcugaaaccauuaaauaaaguaggaggugaggaaaucggaagaauacaaggaugaug

SEQ ID NO: 2243337 - RNA, 62 nt, Homo sapiens
gauucauuucugacaugauuuggauguauuuuccccuccaaaucucauguugaaaugugauc

SEQ ID NO: 2243338 - RNA, 59 nt, Homo sapiens
gagauauguuggcagcugguaugcacuucaucagagggcaaauuacugccacacauuuc

SEQ ID NO: 2243339 - RNA, 56 nt, Homo sapiens
uauauacuaugcgauuccugccuuaaaaacugcaggaauggcaccauuagcauaua

SEQ ID NO: 2243340 - RNA, 91 nt, Homo sapiens
ugagucuucucauucuagacacuagauaugugacugauugagugaggaagacaaucacucacaugccuagugucuaggauaagaagauuca

SEQ ID NO: 2243341 - RNA, 69 nt, Homo sapiens
ucauguauggcucuuauuauuugagguauauuccuucaauaccuaguuuauugagaguuuuuaacauga

SEQ ID NO: 2243342 - RNA, 119 nt, Homo sapiens
ucuuggcuccuugaucugugcugaggugauauauacauauuuuaaacuuaaucuucaaacuaauccucauagguagguaagguauuauuaucucuuuuuuccagauuaaagaucuaagg

SEQ ID NO: 2243343 - RNA, 57 nt, Homo sapiens
gagcaggauggcacuucugugaagugggcugaugcucacacagugcugucacugcuu

SEQ ID NO: 2243344 - RNA, 67 nt, Homo sapiens
cuccggggcaggcacucacagcagccacaagcaccgccaccucguggccugugaguccuccccggag

SEQ ID NO: 2243345 - RNA, 57 nt, Homo sapiens
gacugagaguuucuggauaacauaaaccacguuucuguuaucauuacguucuuaguu

SEQ ID NO: 2243346 - RNA, 98 nt, Homo sapiens
gcgaucacggguuuuggcagugcccgaugcuggggcuugggucugaugugaccccgauuccuucuccagugcgggacucccgccgcccuaacuuucgc

SEQ ID NO: 2243347 - RNA, 91 nt, Homo sapiens
ggagaaucgcuugaaccugggaggcucggagguugcagugagccgagauugugccauugcacuccagccuaggcaacaaaagcaaaacucc

SEQ ID NO: 2243348 - RNA, 90 nt, Homo sapiens
gguccaguugcauuuucauguaauauauuucaggccacaagcuguugugaagccuauuucaguuauguggaaaguguuacuucugagauc

SEQ ID NO: 2243349 - RNA, 66 nt, Homo sapiens
gugucagaaucugagacgacaacauuaggugcucgcaccugacguugucaucugagauucugacac

SEQ ID NO: 2243350 - RNA, 58 nt, Homo sapiens
uaggucaguuuuggcuuggcuuggcugagauuggcuggguuugucuagacuggcucua

SEQ ID NO: 2243351 - RNA, 101 nt, Homo sapiens
guuauaagggauuuuggguaucaucuaaccccuucauuuuacaggauaacagauucauugaggugagauggcuaccccaaguuaggaaucccaucaguagc

SEQ ID NO: 2243352 - RNA, 61 nt, Homo sapiens
gguuuauaagguuucugcuuagaagucugcuuuuagacugauaaguuuuucuuuauaaguu

SEQ ID NO: 2243353 - RNA, 76 nt, Homo sapiens
ugacuucauguuuugguugucccuggccaguccagcugguagaugucuggauacauggcaaaaccagagcacagca

SEQ ID NO: 2243354 - RNA, 56 nt, Homo sapiens
gcagguagggucuggcuggggaacuuggggcccuucaacagguagacccucccugc

SEQ ID NO: 2243355 - RNA, 88 nt, Homo sapiens
ggagaauugcuugaacccgggagguggaaguugcagugagcagcgaucacgcuacuguacuccagccugggugacagagcaagacuuc

SEQ ID NO: 2243356 - RNA, 71 nt, Homo sapiens
uauguaagugcaugacaaugauugcucuucauuuaaaagaugaaagaauauuuuuaugcaaauauuacaug

SEQ ID NO: 2243357 - RNA, 55 nt, Homo sapiens
aagcacacagaggcggaaggacauaaaguuccugguugauuucccuuugguguuu

SEQ ID NO: 2243358 - RNA, 76 nt, Homo sapiens
uuacagauuugggguauaugcuaaaguuaccaaaguuguagaaaauaaggccgggcauuguggcucacaucuguaa

SEQ ID NO: 2243359 - RNA, 78 nt, Homo sapiens
aaauggaaaugaaguauuaggacacauuuaugcuuuucacuugagauaaauguggaagucauacauaauuuacuauuu

SEQ ID NO: 2243360 - RNA, 82 nt, Homo sapiens
caugcacagugauaucugaagaauuauugcuuccuuuccaauaucauuccacaagcauuauugagaugauccugcaugcaug

SEQ ID NO: 2243361 - RNA, 113 nt, Homo sapiens
uuagccgggcauggaagugcaugccuguagucccagcuacuugggaggcugaggcaggauugcuugagccuguagugagcugugauugcaccacuguacuccagccuggguga

SEQ ID NO: 2243362 - RNA, 55 nt, Homo sapiens
cagccucggcaacaacagagacuuugaaccagauaauucuuuguugugggggcug

SEQ ID NO: 2243363 - RNA, 63 nt, Homo sapiens
guuucuuuuggguugacuuuuagggcuguuuugauucugcaaucuaaucaucccagaagaaau

SEQ ID NO: 2243364 - RNA, 83 nt, Homo sapiens
guggggugggagaugggcugugaauaaggcuugggucugaacucuaacccuuacaacuacacucgucuuuuucaguucuucac

SEQ ID NO: 2243365 - RNA, 82 nt, Homo sapiens
ccucagggaaagagaacuuucuguguuuuuaucuccacccccaguggaaggauauguugaguagaguuuuugcuuuuugagg

SEQ ID NO: 2243366 - RNA, 104 nt, Homo sapiens
uaucuggaauccuccgcaugcuaucagauugcugccaucugcuugagccacucugccugccaagcagacugcuuccagucucaugauguggggagcucugggua

SEQ ID NO: 2243367 - RNA, 84 nt, Homo sapiens
auccugucucagcguccuaaguagcugggaguacaggcaugcaucacuaugccugccuuuucauauuuuuaguagagacagggu

SEQ ID NO: 2243368 - RNA, 58 nt, Homo sapiens
cucccgaguucaagcuauuuuccugccucagccucccaggaagcuggaauuacgggag

SEQ ID NO: 2243369 - RNA, 73 nt, Homo sapiens
guuggguaagaucugaggcuaggauaggcugauucuuggagucaguaaacuucagcuucuaauagugcuuagc

SEQ ID NO: 2243370 - RNA, 59 nt, Homo sapiens
uccaaggucuuuguuuggucuguaucagggcuacacaagccucauacaacaagcuugga

SEQ ID NO: 2243371 - RNA, 129 nt, Homo sapiens
aagguguaacgugaugaaaagcuauuuguaaaauugucuuuuguaugaauuugcauggugguauuugucugguauuaugcacuuuauaaaaauuauuauuuuuaauugaaaauauuauuuccgauaccu

SEQ ID NO: 2243372 - RNA, 60 nt, Homo sapiens
gagggcaagacuuguuaagaacagggugcucuggcauguuuuaaaguguuuuguuuccuc

SEQ ID NO: 2243373 - RNA, 78 nt, Homo sapiens
uuaggauugcuuauuuguuaaccuggucuccuugcuacaguuuuugggagacauguuugccaauaauuuaaguucuaa

SEQ ID NO: 2243374 - RNA, 67 nt, Homo sapiens
uugacauuuuucuaaccuauauauaaaguacaaaaauacacuugauauggugagaaaguagugucaa

SEQ ID NO: 2243375 - RNA, 75 nt, Homo sapiens
gccucuggagucagaagugcuggguucaggcugggcgugguggcucacgccuguaaucacagcacuuugggaggc

SEQ ID NO: 2243376 - RNA, 63 nt, Homo sapiens
caugcaagacaccacgugagaauggaaaaugaccuucagcauuguccguggugucuuuccaug

SEQ ID NO: 2243377 - RNA, 108 nt, Homo sapiens
caccugcauugcccugaaccagcuggcucguguuuucuguccaguuccugcugguaggcaaggcugggcugggcagggcuaaugcuggggcagaaggcuuuccaggug

SEQ ID NO: 2243378 - RNA, 83 nt, Homo sapiens
gaauaaggcaucuauucuuggauugacuagccaaagugucgacgucaaaagcgccauuuuugguuuuauccagggucucauuc

SEQ ID NO: 2243379 - RNA, 68 nt, Homo sapiens
ugcacuugauaaguguguauauucugcuguuguugggugcaguguuuuguauacauauguuaggugca

SEQ ID NO: 2243380 - RNA, 60 nt, Homo sapiens
uuauauauagagggaguaugggagcccccaaaagggacauuugcuuaguuuuauguguaa

SEQ ID NO: 2243381 - RNA, 64 nt, Homo sapiens
uucaguuugccaguauuuuauugaggauuuucgcauugauguucaucaggaauauuggccugaa

SEQ ID NO: 2243382 - RNA, 55 nt, Homo sapiens
uccaguacaugcucuugggaacuugucaaaaaugaguucccuguaggugugcgga

SEQ ID NO: 2243383 - RNA, 66 nt, Homo sapiens
uucuuuaggacacucucuccaccaguaauugacaaagucugcuucuguugagugucugauaaagga

SEQ ID NO: 2243384 - RNA, 71 nt, Homo sapiens
augaaugcaugaagguugggugaauagaaugucguugauuaggauaaguagcuccuagccuccaagcucau

SEQ ID NO: 2243385 - RNA, 72 nt, Homo sapiens
guuuaauuuuagguugucaagccagccuuaugcaucacaacuuuuaggccucuugucuugcuuagaauagac

SEQ ID NO: 2243386 - RNA, 74 nt, Homo sapiens
ugauuugaucuguuuuccuauuguuuguugaugcuuuuauugacagaauuaaugaaaauuacaagguuaaguca

SEQ ID NO: 2243387 - RNA, 66 nt, Homo sapiens
gggagccauggcagaaucaagccgacagccuuagucaggcugcagccuucuugccauuaaacucuc

SEQ ID NO: 2243388 - RNA, 103 nt, Homo sapiens
uugagauggagucucacucugucacccaggcuggagugcagugggguaaccucaggucacugcgaccuccgccucccggguuccagugauucuccugccucag

SEQ ID NO: 2243389 - RNA, 75 nt, Homo sapiens
uuaagcaaaggggaauaagaaguggaagggaccgguuaacugacuggaaucucuggcuucuuacucccuacuuaa

SEQ ID NO: 2243390 - RNA, 76 nt, Homo sapiens
aagaugcagauuaccaggccccacccuagacucacugaauuagaaucucuggagguagggccuaggaaucuauuuu

SEQ ID NO: 2243391 - RNA, 55 nt, Homo sapiens
uauugaacgugggauauugaagucucuaagagacuucaauaucccacguucaaua

SEQ ID NO: 2243392 - RNA, 79 nt, Homo sapiens
cauuuuacuccugacugauuacauuacauauugauauuagugagcaucaguauguagugcaaucagucaggagaaaaug

SEQ ID NO: 2243393 - RNA, 55 nt, Homo sapiens
uugagauggaaucuugcucugucuccuaggcuagagugcaauggugccaucucgg

SEQ ID NO: 2243394 - RNA, 69 nt, Homo sapiens
ggcggagcuugcagugagccgugcagugagccaugcagugagcugagaucacgccacugcacuccagcc

SEQ ID NO: 2243395 - RNA, 91 nt, Homo sapiens
ucucccugacaagacuauacacuuuuugaaaauagagacacuguauuuugugucuucuguacuccuugaguagugcuagucccaagggaga

SEQ ID NO: 2243396 - RNA, 84 nt, Homo sapiens
gugccaauaauauuuuuaaaauugcuauacauguggaagaaaaauucuuucaagucaauuuuugaaugacuguuuguuagguac

SEQ ID NO: 2243397 - RNA, 79 nt, Homo sapiens
gcuccuugauggucuggccucaguaagguggugaaauuuccuauucaccuuuacaacuuguuagaguauuacaaggagc

SEQ ID NO: 2243398 - RNA, 57 nt, Homo sapiens
gcaucacagggagacaggccuccggauaacugcgggcaggucugacuaaugugaggc

SEQ ID NO: 2243399 - RNA, 81 nt, Homo sapiens
aaaaucaccucgggagacuuugaagaaguagaaguuccuguguuuuaucccuucccuuucuggaguuucccaagugauuuu

SEQ ID NO: 2243400 - RNA, 88 nt, Homo sapiens
augaagcugcuuccaucagugaaauauuuaacguccaggucccugaggggccuaucugucaaauuucucuggccugagaacacuucau

SEQ ID NO: 2243401 - RNA, 78 nt, Homo sapiens
ugauccuacugugugaaucaauugaucuaugugucugaucuuucacagaaccauacugucuugauuauuguaguauua

SEQ ID NO: 2243402 - RNA, 65 nt, Homo sapiens
uaggauuuuguaguucuucacaggaccuaaaaaaguccuuauggugagguauacugggaucacua

SEQ ID NO: 2243403 - RNA, 57 nt, Homo sapiens
gcagcggucauggauucagguccagcaaguccauacuauucaauccauuggcccugc

SEQ ID NO: 2243404 - RNA, 88 nt, Homo sapiens
cuccccucugcccugagauucuuggauucugccucaccucaucgguguuuugguagaauucaagauucaacaggcuuuuugaugggag

SEQ ID NO: 2243405 - RNA, 63 nt, Homo sapiens
ugagcagagaucacggcauuguacuccauccagccuggacaacaagagugaaacucuguauca

SEQ ID NO: 2243406 - RNA, 101 nt, Homo sapiens
aaugcuuugcuuucaaugcauugguuuucuauauaaguauuagauucuaaauucagguguuauggagccaaacuacuagcaaucucugaaagcuucucauu

SEQ ID NO: 2243407 - RNA, 68 nt, Homo sapiens
ggguacaugugcacaacaugcaguuuuguuacauauguauacauguaccauguuggugugcugcaccc

SEQ ID NO: 2243408 - RNA, 77 nt, Homo sapiens
cuuuaaaacauaagcaaaauaaucacaaacaugaggccugaugguaucagugaaucuuauuuugccuggauuugaag

SEQ ID NO: 2243409 - RNA, 61 nt, Homo sapiens
gcaggugagccuuccagguguggguccccuccugggcacucacugugagaguuuauccugu

SEQ ID NO: 2243410 - RNA, 55 nt, Homo sapiens
ccuggcagccuuguuuguuggcuuuuucagguguaacagucaagguuugaccagg

SEQ ID NO: 2243411 - RNA, 61 nt, Homo sapiens
uauuauugcuggcucugucuucauucuggaacccagacagauagaaaagccaucaguagug

SEQ ID NO: 2243412 - RNA, 61 nt, Homo sapiens
cuggcaagaggauaaaguccuaacuccuuaucauggaguccaaacuauaucuacuuuccag

SEQ ID NO: 2243413 - RNA, 55 nt, Homo sapiens
aggucuuucccuucccgugaggccauauuucaggcuaucacauggggagaaaccu

SEQ ID NO: 2243414 - RNA, 67 nt, Homo sapiens
auauuggccaggcuggucucgaacuccugaccucagcugaggagacugagacaauccuggucaauau

SEQ ID NO: 2243415 - RNA, 57 nt, Homo sapiens
cuacagaguaucuaaagagguaaaggcuagaagugagacuuugaaagauaccugugg

SEQ ID NO: 2243416 - RNA, 63 nt, Homo sapiens
uuucauuguaauacaguuuccauuuuuaauuaaaugaauaaaauagcuguguugccugugaga

SEQ ID NO: 2243417 - RNA, 57 nt, Homo sapiens
cucagugaagggcaagaggcaaccccacucuuccaguuguucaggccccacacugag

SEQ ID NO: 2243418 - RNA, 76 nt, Homo sapiens
guauuagguuggugcaaaaguaauugugguuaaaaguaaugagaaaaccucaauuacucuugcaucaaccuauaac

SEQ ID NO: 2243419 - RNA, 97 nt, Homo sapiens
gauggugucagagaucaacugaauuacuggacaccuagcugguguucagagaauuggauaauucguugaugugaaaagaaaccucugauuugguguc

SEQ ID NO: 2243420 - RNA, 66 nt, Homo sapiens
uaugucaugggguuuuugagauaacuaaauuauuuacguaaguugcugaagacacugcauggcaua

SEQ ID NO: 2243421 - RNA, 64 nt, Homo sapiens
uagauuaucauucauacagggaagaaccagcauuuucuuaguucuccuguagauggcgaaucua

SEQ ID NO: 2243422 - RNA, 63 nt, Homo sapiens
ggaaaugguagagaggcugaaauagauaucuacaucuauauagcuaugucuguccauugaucc

SEQ ID NO: 2243423 - RNA, 72 nt, Homo sapiens
gacuccagagugcauucguaugaacuguauguucggggcugauguuacaguauuaugagugauugaaaaguc

SEQ ID NO: 2243424 - RNA, 68 nt, Homo sapiens
ugugaacugagcauuaacuacaggagaagcaccauccuugccauauguguuauaugucucauaucaca

SEQ ID NO: 2243425 - RNA, 75 nt, Homo sapiens
guuaggcuucaguucuguaaggacagcagugguuuucuuuucuguucacucuguagccucagaacuggguguaau

SEQ ID NO: 2243426 - RNA, 130 nt, Homo sapiens
agugcugugaguccgggaugaaguagcaguuacaggacuaagcagcuuugccuauucauuuugacugcaaggacaccuccuuggucuugucgaaacuguggaccucauuuuguuuauuuauuuauuuauu

SEQ ID NO: 2243427 - RNA, 69 nt, Homo sapiens
gaggcgggcggaucacuuugaugccaggaacuggagaccagccuggccaacauggugaaaccccgucuc

SEQ ID NO: 2243428 - RNA, 71 nt, Homo sapiens
gaaaguuguuguuguccaguguuauaaucacagaacuaaaagugauggcacuaaguucaacacuuauuuuc

SEQ ID NO: 2243429 - RNA, 82 nt, Homo sapiens
uucucuuggagccaguacuacuuucucuucugggaaauucugcucuugaauuucccuacuaguuagugugacuucaagagga

SEQ ID NO: 2243430 - RNA, 69 nt, Homo sapiens
ugaaagcuuuugggcaagauuuaaagaaacuguuuaauuucuacugauacuguauccuaaaagcuuuua

SEQ ID NO: 2243431 - RNA, 57 nt, Homo sapiens
gucaggugcuuacgcggagaucuccuucccguucaggauuucugcuggcgccauggc

SEQ ID NO: 2243432 - RNA, 92 nt, Homo sapiens
agcucccgauaugaaaaagcaugacuugaggaaguucuucagugcaaaagaaggaaucuaagguaucagguuaugcgauuaugcuggcagcu

SEQ ID NO: 2243433 - RNA, 84 nt, Homo sapiens
gcuaguguaggcagccagcuguggauugaagaguuugcugagucaauugguauaaauuuggauccaaggcuggccuaugauagc

SEQ ID NO: 2243434 - RNA, 79 nt, Homo sapiens
agauccauaagcuggaauuuaagguagauagguaggguggaaacauauugucgcuagucucaaauaucagcauagaucu

SEQ ID NO: 2243435 - RNA, 55 nt, Homo sapiens
uagcaguauugaaagaugagggagcuacaucuuccuugacaucguugugcugcua

SEQ ID NO: 2243436 - RNA, 122 nt, Homo sapiens
cugaguggugguuacuggcuugccacugaugagaggcauuuguagaacuccucagaauccacuuggagaccauuuacugccuacuuagccuggcacaccauggccuucucaaauaccaucag

SEQ ID NO: 2243437 - RNA, 58 nt, Homo sapiens
cugucuccuccacugcaugggagacucaucacggaagcuugcacagagaaggaggcag

SEQ ID NO: 2243438 - RNA, 88 nt, Homo sapiens
ggagucuugcucuguugccuaggcuggagugugguggucuggucucaguucacuacaacuucugccuccgaggcucaagcgauucucc

SEQ ID NO: 2243439 - RNA, 56 nt, Homo sapiens
aggcaucuaggcucacuggaaccucugccucccggguucaagugauucucaugccu

SEQ ID NO: 2243440 - RNA, 64 nt, Homo sapiens
uggggagugcuuuaugccuguggauucaggacacaccagcaaccuacacguguagcauucucua

SEQ ID NO: 2243441 - RNA, 79 nt, Homo sapiens
uggaauucugugcguuauucuauaaagcuuaguugaauguuuuagcugaguagaaauaaacgcaaacugaguuauucca

SEQ ID NO: 2243442 - RNA, 81 nt, Homo sapiens
ugaucaugguggauaagcuuuuugacgugcugcuguauuuguuuugccaguauuuuauugaggguuuucacguuauguuca

SEQ ID NO: 2243443 - RNA, 61 nt, Homo sapiens
agguagaggcuggaaaccucagagcagcuagccucuuuggguguauuucacagccaucccu

SEQ ID NO: 2243444 - RNA, 57 nt, Homo sapiens
cagguuauugugggugcuggagggaaugacuuucacucugagucauucaguggccug

SEQ ID NO: 2243445 - RNA, 58 nt, Homo sapiens
guguauaucacaguacccucugaaaauacaguuuugagaacuaaaaugugguauauau

SEQ ID NO: 2243446 - RNA, 94 nt, Homo sapiens
ccuggauuugcagcucuuucuucucuuguuccagagcaucuucaaacucaaugaauuucugugcauggaagggagggaaagagcagucaucagg

SEQ ID NO: 2243447 - RNA, 59 nt, Homo sapiens
ugaguggagaucgcaccauugcacuccagccugggugacaagagugaaacuccaucuca

SEQ ID NO: 2243448 - RNA, 74 nt, Homo sapiens
uaggaguugacagaagcgggauuugaacccagaccuucuuguuccagagucaccuuucugucgacuacgcccug

SEQ ID NO: 2243449 - RNA, 80 nt, Homo sapiens
gcccggacugcugucacaguccagccuaguauguauaccauaugguuugauacuggguguggacaaaguagucagugggc

SEQ ID NO: 2243450 - RNA, 99 nt, Homo sapiens
gaggcaggagaaccacuugaacccgggaaguggaggcugcagugagccgagaucacuccauugcacuccagccugggcaacagagugagacucugucuc

SEQ ID NO: 2243451 - RNA, 60 nt, Homo sapiens
uucuggggguauuuugauuuguggacguggagaaagugguagagagcaauaccuccagag

SEQ ID NO: 2243452 - RNA, 74 nt, Homo sapiens
agcauuucauaucauuagaucuacuguauggagacaccugugcaauugaucaaauguauaugaacaaggaugcu

SEQ ID NO: 2243453 - RNA, 79 nt, Homo sapiens
cagccuguucugucugccucggucucugaaguccguguaggauucacaguaucaugggggacagaagugcuauagguug

SEQ ID NO: 2243454 - RNA, 57 nt, Homo sapiens
ucuagcacuuacuggcugugugacuagaacuguaacacacaguagcuugugcauaga

SEQ ID NO: 2243455 - RNA, 57 nt, Homo sapiens
gagagggugggaccaguuccucucuuuugguuaguccagcugguuguccacucucuc

SEQ ID NO: 2243456 - RNA, 78 nt, Homo sapiens
ggaaagcggcaggugauucagcaauuuuuguagcacgacagguugugcacaaaguguuuucugaaggccugcacuucu

SEQ ID NO: 2243457 - RNA, 62 nt, Homo sapiens
uuaguaguaaugaauucauggauaaucauuuuauucuauggguuauaauucauuaguauuag

SEQ ID NO: 2243458 - RNA, 75 nt, Homo sapiens
agauguuugaucgguguccauuagucuuuucuugaaaauauuacucaaagagaucuaugggcacuauguauaucu

SEQ ID NO: 2243459 - RNA, 60 nt, Homo sapiens
ucugguguguagagaaauagccugaaggcacuuugugcuugccuggccucucugcccaga

SEQ ID NO: 2243460 - RNA, 88 nt, Homo sapiens
gggggauaggaacuguucugugcauuguaggauguuuagcagcacccugacugaguacccacuagaugacaguagcaacaccaccccc

SEQ ID NO: 2243461 - RNA, 76 nt, Homo sapiens
aggcgaagcuaugaagccagccauaugccauguuauaauuaugaugccguaaaucucuguuuucauggaccugccu

SEQ ID NO: 2243462 - RNA, 76 nt, Homo sapiens
guguccaguuguuuucugagguugugccuuucucauagagccuuuccaaaugcaccuaaaagcaacugauugacac

SEQ ID NO: 2243463 - RNA, 103 nt, Homo sapiens
uugagacagagucuagcugugucacccaggcuggagugcaguggcgcaaucuuggcucacugcgacguccgccucccggguucaagcaauucuccuguuucag

SEQ ID NO: 2243464 - RNA, 62 nt, Homo sapiens
ccaucuugaaggcuagcugacacagauuauuuuuugugcgugugccuguaagaauuuuuugg

SEQ ID NO: 2243465 - RNA, 103 nt, Homo sapiens
ugauguguuuaacucauuuaaugccccuaucaacccuaugagguagguacaauuacuaucuccauuguccagaugaggaaauuggguaaguuaaacaacauua

SEQ ID NO: 2243466 - RNA, 100 nt, Homo sapiens
ugaggcaugagaaucacuugaaaccaggaggcggagguugcagugagcugagaucacaccacugcacuccagccucaugacagggugagacuuugucuca

SEQ ID NO: 2243467 - RNA, 61 nt, Homo sapiens
uuaggagcugaaguccuugaugccccucucagcagguguauccugaaguucucagcacuaa

SEQ ID NO: 2243468 - RNA, 62 nt, Homo sapiens
uuaugcuaaguggaagaugucaaucauaagagaccuccugugaucugauuccauuuauauga

SEQ ID NO: 2243469 - RNA, 88 nt, Homo sapiens
guggacuuaggagguagagagugcuuuggguguaggccagguaaguuucuggucugccugcauuaggcacuugguagcuguuagcuau

SEQ ID NO: 2243470 - RNA, 60 nt, Homo sapiens
ccuaaagugcugagauuauagguguaagccacugcaccuggacuuuuuagacauuuuagg

SEQ ID NO: 2243471 - RNA, 124 nt, Homo sapiens
ucccaucauaucugguugugagagaaucuugguauguguuucauacucaaggaaacacauacucaaauauuccuugaguauggaaacacauaccaagauucucucacaacuggauaugauggga

SEQ ID NO: 2243472 - RNA, 128 nt, Homo sapiens
gaguugauuuuuguagauaauggaaaggaagggauucaguuucaauauucugcauauggcuagacaguuuuaccagcaccauuuguugaauagggaguccuuuccccauugcuuguuucugucaauuu

SEQ ID NO: 2243473 - RNA, 58 nt, Homo sapiens
ugcuugguugacaucugcaugcucacaggaucuuggaaagguaggucaguaccaagca

SEQ ID NO: 2243474 - RNA, 79 nt, Homo sapiens
ugggguacaggugcaggaugggcagguguauuacauagauaaacauaugucauggucauuuacugcaccuaucaaccca

SEQ ID NO: 2243475 - RNA, 86 nt, Homo sapiens
acuagugaguuuguuuaccugauuuguggccaauuugagucugauuaagaaucuuaaaguguuugcagacaggugguaaaauuggu

SEQ ID NO: 2243476 - RNA, 61 nt, Homo sapiens
gcccaggcaugguuaaagcacuuugagugguuuguaugccugaaguguaaccgugcagggc

SEQ ID NO: 2243477 - RNA, 80 nt, Homo sapiens
ugcugauuacaaugugauaguugcuguucugggcagaaguuccugcugaguuacgguaauugcucaggguguuaacagca

SEQ ID NO: 2243478 - RNA, 57 nt, Homo sapiens
uuucaggguuggaucuuuauuaauauguaauaucuaugagguauccaagcccagaaa

SEQ ID NO: 2243479 - RNA, 71 nt, Homo sapiens
gcuugggauuuaguuuuggacaaaaagaugcaucaggaaggugcauggacucauugaauuaagucccaggu

SEQ ID NO: 2243480 - RNA, 78 nt, Homo sapiens
ccuucagcucaauggcccagggucuacagccucaagaccuccuugaugcuacuaccugggcugaaagcugauucaagg

SEQ ID NO: 2243481 - RNA, 86 nt, Homo sapiens
uucccucugggccuggcacagugucagaaacacagaaggcaugaaaauguguguguuaugaaugacugagcaagugcaugagggga

SEQ ID NO: 2243482 - RNA, 84 nt, Homo sapiens
uuguagcuggugauugguuucauucaguggaagagcugcaaauaaacuaagcuaacuggguaacagccaaggccaugguuacag

SEQ ID NO: 2243483 - RNA, 63 nt, Homo sapiens
guggaauacuaccuaagauguuccuacucuagagaugagaaccuccagcaagguaguacccau

SEQ ID NO: 2243484 - RNA, 76 nt, Homo sapiens
auggaccauagcauagucagcuucgcugauucagcucuuuucacuagucaccguggcugaacuauuuugucaccau

SEQ ID NO: 2243485 - RNA, 73 nt, Homo sapiens
ccaccccaccugcuuccugugaccuggacacagucugagcaccccaagguccaaagugggagagguggggugg

SEQ ID NO: 2243486 - RNA, 62 nt, Homo sapiens
caauucaguagccacuauacacaugcagcuguuggguacuugauauguggcuauugagauug

SEQ ID NO: 2243487 - RNA, 67 nt, Homo sapiens
uugaggaggcagucuguccauucucagagcucaaacaccaugcuuggagaagcauugcucucuucag

SEQ ID NO: 2243488 - RNA, 65 nt, Homo sapiens
aguggcugagauuuauugagcaacuacuauaugcuaaggguuguaugcuuauugucucauccacu

SEQ ID NO: 2243489 - RNA, 116 nt, Homo sapiens
uugguguugguguacgggggauugaucauuagguggaacacacaggagaucuaagaugcugaaacaauucuguguaauacucuaaugaugcauacuugccauuacacccuuaucaa

SEQ ID NO: 2243490 - RNA, 66 nt, Homo sapiens
ucacuacugucagacugccacugauacuuauucaggccugagaucacuuuagucagacagugguga

SEQ ID NO: 2243491 - RNA, 76 nt, Homo sapiens
gacaugauuaaguauuaugugcugcauuuugagacaauccaaaaugugaaagccuauaacgacugacuguuguguc

SEQ ID NO: 2243492 - RNA, 62 nt, Homo sapiens
gagaaggacuuuggugaagcuuucccugguauuuuucugcuaaagcuuuggcuaacuuucuc

SEQ ID NO: 2243493 - RNA, 94 nt, Homo sapiens
gagaugugaauauagacagggguagagaauuaugaccauuuuggaaaucuacaguacugcauuugguuuuugugccucuuuuauaauuaauuuc

SEQ ID NO: 2243494 - RNA, 84 nt, Homo sapiens
cacuuuuucugcagggccaaugggaaguugaaaguaccugugacugguacuuuuugcaaccauuuggaccuuugcguaggagug

SEQ ID NO: 2243495 - RNA, 93 nt, Homo sapiens
gggucuuuaugguaauggcaauaauagcuaccauuuauuaaguauuuauauuggggaugguuaaguauaugcauugucucuuuauaacuaccc

SEQ ID NO: 2243496 - RNA, 124 nt, Homo sapiens
ggccuccagaacugugagaaaauaaauuucuguugcuuaagccacccagucuguggguagcacagacucaugguagccugagccaacuaauauggugcuauuccucacuccuaucccuguugcc

SEQ ID NO: 2243497 - RNA, 75 nt, Homo sapiens
gcuauugugaguagugcugcaauaaacauacgugugcauguguguuuauagcagcaugauuuauaauccuuuggc

SEQ ID NO: 2243498 - RNA, 109 nt, Homo sapiens
gcugagugacauuagugucaucaaugaccuugcagagcccauggaugucacucuccacagacugacgcauggccagcucugucucauacuugacucuaaggucaucagc

SEQ ID NO: 2243499 - RNA, 83 nt, Homo sapiens
cugggugggcaucugcugggugcgcuccuguuaugcuuucugcugugacagagaagcauugaguucaguuuaaugucccccag

SEQ ID NO: 2243500 - RNA, 123 nt, Homo sapiens
cauaccgugcaauauuaugcauaauaaauuuccaaauggauuucagcugaguauucaguauguuacugaauacuggcacugaagaccaugaaaugcacauaauagaacuguacuuuuggugug

SEQ ID NO: 2243501 - RNA, 59 nt, Homo sapiens
ucuucuacagugacugcagccauagcauugaugcugguggaugcugugcugugugagga

SEQ ID NO: 2243502 - RNA, 89 nt, Homo sapiens
ggaguuucgcucuugucaccgagguuggagugcaguggugcaaucucggcucacugcaaccuccgccuccuggguucaagcaauucucc

SEQ ID NO: 2243503 - RNA, 89 nt, Homo sapiens
ggagaaucgcuugaaccugggaggcggagguugcagugagcugagauagcaccauuguacuccagccuggacaacaggagcgaaacucc

SEQ ID NO: 2243504 - RNA, 69 nt, Homo sapiens
cccucauuguaacacaugcugcucucuggugggcaauguugaaaaccagggagcuggcauguguggggg

SEQ ID NO: 2243505 - RNA, 74 nt, Homo sapiens
ugacccuguggcagcgucuaagggugaaugguuauagcuccugaagccccagugggcguguguuacagggugca

SEQ ID NO: 2243506 - RNA, 73 nt, Homo sapiens
ggauuagaggugugagccacugugcccagccccuuaugauauacccaguucacagggugaacaccccuaaucc

SEQ ID NO: 2243507 - RNA, 87 nt, Homo sapiens
guggcacaugacuguaguuucagcuacuugggaggcugaagugggaagaucacuugagccuaggagguugaggcugcagugagccau

SEQ ID NO: 2243508 - RNA, 58 nt, Homo sapiens
gcugaucacauuuccaaaacccauucguugacauagggguuuuggaaaugugaacagc

SEQ ID NO: 2243509 - RNA, 103 nt, Homo sapiens
cugagacagaguuucgcgcugucgcccaggcuggaguacaguugugugaucucagcucacugcaacauccaccuccuggguucaagugauucuccugccucag

SEQ ID NO: 2243510 - RNA, 63 nt, Homo sapiens
cuauguguccauguguucucaucauuuaccucccacuuguaagugagaacaugugguauuugg

SEQ ID NO: 2243511 - RNA, 89 nt, Homo sapiens
gaagcaagugcuuuacacaugcaugauuuuaucaaggagauuauggagaccuugaaggccauccaugcauguuaaaaaccuuugcauuc

SEQ ID NO: 2243512 - RNA, 72 nt, Homo sapiens
aggaaugcuuuuacacuguuggugggaguguaaauuaguucacccauuguggaagacaguguggcgauuccu

SEQ ID NO: 2243513 - RNA, 101 nt, Homo sapiens
aaggaaugaucaacuaaaucaaauguugcuaagucaagagaaaugaugacuauugagaaauuaacuugagauuuagcaauaugaagaucauuggugaccuu

SEQ ID NO: 2243514 - RNA, 60 nt, Homo sapiens
agcugguccugugacuugcuucuuucaaauuucuuggccuggaaagugcaggcaccagcu

SEQ ID NO: 2243515 - RNA, 108 nt, Homo sapiens
ucugggccguggcugaggcuucaaggugucuaagagcugcccgggagauuuuacugugcagccuggguagagaaucaggaucuuagagccucuucuguggccaacaga

SEQ ID NO: 2243516 - RNA, 70 nt, Homo sapiens
cauccaugugugaaucccagaaccugugacuguuaccuuacauggcaaaagggacuuuacagcagaggug

SEQ ID NO: 2243517 - RNA, 63 nt, Homo sapiens
ucuuggaaacauggugcugccacccugcaccuuacauacggcggcagcaccauauuucuaaga

SEQ ID NO: 2243518 - RNA, 62 nt, Homo sapiens
agugacaagagcuaggcuuuuucaaguuagacagauuuggcuccaauucuggcucugucacu

SEQ ID NO: 2243519 - RNA, 83 nt, Homo sapiens
agagauguggcaccuacucauuuuucagcucacuauccauuacaacagggcgugguguuagaaugagaaguuugcauguuucu

SEQ ID NO: 2243520 - RNA, 90 nt, Homo sapiens
cuuuaaacagcuuuacugagguacaauuuauauauuauaacuuucacccuauguaagugugcaauucagugaucuuugguaaauuuagag

SEQ ID NO: 2243521 - RNA, 78 nt, Homo sapiens
aauaaaugaggcacuguauuuuauugcaaaacacuaaaacaugaugcaaaugaccaaaagugcaguacuucguauauu

SEQ ID NO: 2243522 - RNA, 55 nt, Homo sapiens
gggaggagguucagacccaagguggcggcugcggcugguguuagcacuucuuccc

SEQ ID NO: 2243523 - RNA, 67 nt, Homo sapiens
gucuccaaggaaugcuaaguuuuccuccugucaugagagacaggagguaaaauuggcaucaggagac

SEQ ID NO: 2243524 - RNA, 78 nt, Homo sapiens
uguuuuggagaacaguucgugugcuaaugaaaagaauguaaauucugcaguuguugcauagaauguucuguaaauaca

SEQ ID NO: 2243525 - RNA, 90 nt, Homo sapiens
aggcuggucuugaacuccuggcauugugauccaccagccuuggccucccaaaguggugggauuacaggcaugagccaccacgcccagccu

SEQ ID NO: 2243526 - RNA, 59 nt, Homo sapiens
agucagugcauaagaaugaaguagguaugaguucggagcuaaauucuuaagcucuggcu

SEQ ID NO: 2243527 - RNA, 99 nt, Homo sapiens
cuuuuacagaugagaugaaguuaaggaucuuuagguaaagagauuaucauggauuaccugaguggauuauugauguuaucucaagcauccuguuaagag

SEQ ID NO: 2243528 - RNA, 85 nt, Homo sapiens
auauuuaggauacugguaugggcugaauugugucccugcuaccaauucauauguuuaagcccuaagcgccaguaccucagaaugu

SEQ ID NO: 2243529 - RNA, 95 nt, Homo sapiens
ggaaacccaguaacauaugggagggaguuuguuuguauacacauucuuuuaaaauauacauugaucaucuuuccuguuguguuagcuuuauuucc

SEQ ID NO: 2243530 - RNA, 68 nt, Homo sapiens
ggguacaugugcacaacaugcaguuuuguuacauauguauacaugggccauguuguugugcugcaccc

SEQ ID NO: 2243531 - RNA, 79 nt, Homo sapiens
uguguuuuuguggcauugcucauaucacugaaguagacaacaaaauucagucaguguguauugauggcacucagacaca

SEQ ID NO: 2243532 - RNA, 63 nt, Homo sapiens
gaaagugcuggccuacucaaucgagagcaaugcuuucaucgaggagagucgccagcugcuuuc

SEQ ID NO: 2243533 - RNA, 77 nt, Homo sapiens
ucucaaucgugagcaccaggcaaaaccacaggagcaguaccauuguucuggagaguuuagucuggggccuacuggga

SEQ ID NO: 2243534 - RNA, 87 nt, Homo sapiens
gcuugcgggccagcuagaguuccaggugggcgugggccuggcgggccccacacucggagcggccggcccgcccugcuggccccaggc

SEQ ID NO: 2243535 - RNA, 55 nt, Homo sapiens
guguuugcucugauccaaucugcuuucuugcaccuuuuugaauagagccaagcac

SEQ ID NO: 2243536 - RNA, 57 nt, Homo sapiens
uccaugaggcuacaguaaucucacugugguaacaucaggguagcugugguccauggg

SEQ ID NO: 2243537 - RNA, 100 nt, Homo sapiens
gaggcagauguuuagguaauauauugcugcuuugcauuucuauaacaccuuccauguaagagcugcagaguguaacacaaacauuaauaaauuaagccuc

SEQ ID NO: 2243538 - RNA, 87 nt, Homo sapiens
cuuuguucucugcuauauucccagugccaggcacugggaauaccuauguucuuaugccaggcacugggaauauagcagagaauaaag

SEQ ID NO: 2243539 - RNA, 84 nt, Homo sapiens
aacauguuuugaaguguguauacauuguggaguggcugcaucaagcuaaugaucacauguaucaucucacuuucugaucauguu

SEQ ID NO: 2243540 - RNA, 63 nt, Homo sapiens
uucucagugaacuccagcuugucuuccaccuucacucugagauugcucuaggccacuagggaa

SEQ ID NO: 2243541 - RNA, 69 nt, Homo sapiens
ccucuguuuuauaauaacuguagcaagauuccaaagugccuuuguggcagugcuuuaugaaaccagggg

SEQ ID NO: 2243542 - RNA, 67 nt, Homo sapiens
cuuaucuauauuugguuguugauguauccauuaaauuggggcauggaaacauaagaguauagauggg

SEQ ID NO: 2243543 - RNA, 55 nt, Homo sapiens
uugagauggagucucacucugucacccagacuggagugcagugucaccaucucag

SEQ ID NO: 2243544 - RNA, 84 nt, Homo sapiens
acagucucacagucuugcaauauugagaucucauggucucuuagucuuaaagacucucaguauugaaguuugaugacgcucugu

SEQ ID NO: 2243545 - RNA, 61 nt, Homo sapiens
accuauggcugauaguucaugaccacugaucaaugcagggugcauggagaacacugagggu

SEQ ID NO: 2243546 - RNA, 73 nt, Homo sapiens
cugggguucaaguaauuuugguaacuugcugaauuuggcagagaaagugaucaagguaggacuugaacccuag

SEQ ID NO: 2243547 - RNA, 79 nt, Homo sapiens
cuguuggcaauauuuacugaaguugaaaauaugcauguucucucaccaccaguucuacuuccaguuauauagccagcag

SEQ ID NO: 2243548 - RNA, 102 nt, Homo sapiens
ugaggcaagagaauugcuugaacccgggagguggaggcugcagugagccaagaucacgcuguugcacuccagccugggcaacaagagcaaaacuccgucuca

SEQ ID NO: 2243549 - RNA, 64 nt, Homo sapiens
cugauguagguggucugugaucuuuuccuuuauuucugauccacaccugagcaccauauauuag

SEQ ID NO: 2243550 - RNA, 73 nt, Homo sapiens
ggauuuauugagaauugcuauguguuaaggacaugaaggcaaauaagauauggucccuguucucaaggaauuu

SEQ ID NO: 2243551 - RNA, 116 nt, Homo sapiens
uucaguguauauaaaauuuauaaaacaaauacuuuguguuuuuauguaaaauggaauuagauucuaguuucagauaauuuuaaguagcauggguuuuguuuuguuuugcacuugaa

SEQ ID NO: 2243552 - RNA, 102 nt, Homo sapiens
ccccucucucggggacgcgguccucucgcugccuccgggucuugcagccccgucugggacacccggagagcaggcgagaaggaaauccacgaaacagagggg

SEQ ID NO: 2243553 - RNA, 87 nt, Homo sapiens
ucccuccagauccuuacugcucauggucuguguuuguugcuagccauacuaauaagaguaguacauaugagacauuuaggagaggga

SEQ ID NO: 2243554 - RNA, 110 nt, Homo sapiens
gggucucuuaguccaggacuaggcuauuggacagcauuucuagacuugccucuggcccagggcaggucuagaaaugcuuuccaagagcuuaguccuggacucagggaccc

SEQ ID NO: 2243555 - RNA, 64 nt, Homo sapiens
gaguaagugcucuugaaacugucuuagcaaaauuaugacugagacagugaaagagauuuaacuu

SEQ ID NO: 2243556 - RNA, 60 nt, Homo sapiens
auuauugcagggauguuguucagaauguuguuuacagucacacagugucucuauaaugau

SEQ ID NO: 2243557 - RNA, 83 nt, Homo sapiens
aaggaaaaauguuugagaccgaacuucucugucuuagaauggaaugaagucagagaucauuuuguuucaaaucguuuuuuuuu

SEQ ID NO: 2243558 - RNA, 119 nt, Homo sapiens
acuuuuuucuuugccaguaccauuaagggauuugaauuuuuuugagguuccauguuuauuucuuuaguuaugaguaugaccuuggacaaguuacuucucuguaccuguaaagugagagu

SEQ ID NO: 2243559 - RNA, 58 nt, Homo sapiens
auuuugagucuuuaacauacuguuugggaagcccggggcagcgugguggauugaaaau

SEQ ID NO: 2243560 - RNA, 72 nt, Homo sapiens
cugggcaugguggugcaugccuguaguccuagcuacuugggggauugaggcaggaggaccaucuaagcccag

SEQ ID NO: 2243561 - RNA, 82 nt, Homo sapiens
uaagacgaguuagcaaauguaaaaugccuacaacaaugccuggaacgcuguaagcauuauauaauuguugauuauuuccuug

SEQ ID NO: 2243562 - RNA, 90 nt, Homo sapiens
agagguuugggguaugagugaacccauuacccagguagucaguauaguacccaauggguaguuuuucagcucuugcccuccacccccucu

SEQ ID NO: 2243563 - RNA, 99 nt, Homo sapiens
gaggcaggagaaucgcuugaaugcaggaggcagagguugcagugagcugagaucaugccacugcacuucagccugcgcaacagagcgagacuccgucuc

SEQ ID NO: 2243564 - RNA, 87 nt, Homo sapiens
cauuugaugaugauuccauucgaguccauuugaugaugauuccauucgaguccauuugaugaugauuccauuugaguccauuugaug

SEQ ID NO: 2243565 - RNA, 76 nt, Homo sapiens
cagaggcagauacucauaggugauggaugaggaagcugagggaguucuugccuaguggccuuaugaguauucucug

SEQ ID NO: 2243566 - RNA, 130 nt, Homo sapiens
cacacuguuuuuugagguagguaguauuaucaucucccuuuuauagucaggaacuugaggaaaagaggguuuaaguuguucaaguugacauagaaagugauagugcugggauucaaacccaggcagugug

SEQ ID NO: 2243567 - RNA, 68 nt, Homo sapiens
ggugugguaucauuuaaccauuagagaaacccaugaaacaaugacuacuaauuagaugaugaaacacc

SEQ ID NO: 2243568 - RNA, 63 nt, Homo sapiens
guuuuauucaauacagguuguacuagucccuucuugaagugccuacuugaauuguagugaaau

SEQ ID NO: 2243569 - RNA, 70 nt, Homo sapiens
aggaauacguuucggcuuaguacaguuuacacagaguccuggaacuggccugagaugaaaagugcccccu

SEQ ID NO: 2243570 - RNA, 70 nt, Homo sapiens
acuaauggauuaacgucccugucgugugacauuuucugguaugacagcugaagauguugaaccguauggu

SEQ ID NO: 2243571 - RNA, 82 nt, Homo sapiens
gaugcagaauuauuuuugcaauauguuccugaauauguaauauaaguguauugggaucauuuugcauccauaguuuuguauc

SEQ ID NO: 2243572 - RNA, 98 nt, Homo sapiens
ugauccucuguccauaguaaguuacgcauguagugacaaaugcaugccacaaggucuugagauuguaucugcaauguguugcugcuggcuguugauca

SEQ ID NO: 2243573 - RNA, 75 nt, Homo sapiens
ggaucuuggguugacuauuguugguguauaggaaugcuagugauuuuugcacauugauuugguauccugagauuu

SEQ ID NO: 2243574 - RNA, 74 nt, Homo sapiens
uaauuaugguuucauuaugaugcaccauaucagggcuguuguaaugucaugucugcacauaguaaaaauaguua

SEQ ID NO: 2243575 - RNA, 91 nt, Homo sapiens
cugguucugacccuugauuccagaacucucugacaggucucauagcaauucugucaggaguuuuagaaucuuauuaucacucuagaaucag

SEQ ID NO: 2243576 - RNA, 78 nt, Homo sapiens
guuguacacacuggugaauuuuuauuuaagugacucacuauugaugugacuugugaaaaguucagcauaguuggcaau

SEQ ID NO: 2243577 - RNA, 59 nt, Homo sapiens
uugcuugaagugggugguguaaaaucucccacugauuaaacagcacugguuucaagcaa

SEQ ID NO: 2243578 - RNA, 84 nt, Homo sapiens
acuggauucaguucacuguagcuuggauguuuaacuuuucaaauuacgagaaaugagccaggcacaguagagcaugccucuagu

SEQ ID NO: 2243579 - RNA, 122 nt, Homo sapiens
uauuaauugcacugugguuuaguaagggaauaagaugauguucuuuuucuuaggagaucuaugaugaaguauuuuaagguaaaggaacaucauaucuacaaccuacucccaguaguauagua

SEQ ID NO: 2243580 - RNA, 92 nt, Homo sapiens
ggcaggagaaucgcuugaacccgggaggcagagguugcagugagccaagaucacgccacugcacuccagccuucggacagagugagacuguc

SEQ ID NO: 2243581 - RNA, 73 nt, Homo sapiens
uagaguaauguuaggaaggagaguaaaagcaacauucaucaaguugcagcucaaauuccuaacaagggcucua

SEQ ID NO: 2243582 - RNA, 64 nt, Homo sapiens
uucaguuugccaguauuuuacugaggauuuuugcauugauauucaucagggauacuggccugaa

SEQ ID NO: 2243583 - RNA, 58 nt, Homo sapiens
uucugccugauguagucauaccucagaucccucuaggcagagcugcauucauguagaa

SEQ ID NO: 2243584 - RNA, 60 nt, Homo sapiens
gggagggaggagccccggccauccccacccucguggauguaacugguuuucuucccucuc

SEQ ID NO: 2243585 - RNA, 92 nt, Homo sapiens
gagcucugaugauuagguacugugguuuccagaccugugacacacuccucccaucuucgagccccagauaugugacauuuaaacugagacuc

SEQ ID NO: 2243586 - RNA, 56 nt, Homo sapiens
uuuggaauauuuuuucaccugggagucuucuuugguuaagggugaaauguuucaga

SEQ ID NO: 2243587 - RNA, 110 nt, Homo sapiens
aguucaucguaaauuuuuauuaaguucuugccaguuuuuacauuuccugucuucuguuuuucucuucagguacauggaacagaggcuguuaggaaauuugccuugcaacu

SEQ ID NO: 2243588 - RNA, 76 nt, Homo sapiens
cuggcauguguauucauguugaauagacaguucuauucaauagaacuguccauucagcaugaacaagauugaccag

SEQ ID NO: 2243589 - RNA, 59 nt, Homo sapiens
augaagacaucgucugggauuaucuggggagcccuaauuccaaugacagguguccuugu

SEQ ID NO: 2243590 - RNA, 124 nt, Homo sapiens
gccaccaccaucagccauacuauguguagugccuuauucaggaagguguuacuuaauagauuaauauuuguaaggcacccuucugaguagaguaaugugcaacauggacaacauuugugguggc

SEQ ID NO: 2243591 - RNA, 82 nt, Homo sapiens
gcgggaaaaucugacagucucauugauuugcucucuuugccaucaccacucuugagaggaagaaaugugacuucaaacuugc

SEQ ID NO: 2243592 - RNA, 67 nt, Homo sapiens
ucacgugcucuuguguguucugcaaaugacacagcaaugccacuuagacgcacgagagucuauguga

SEQ ID NO: 2243593 - RNA, 61 nt, Homo sapiens
ucauccugacaucucgugaagaguauguugaaaucaaugacacugcagagaugucccauga

SEQ ID NO: 2243594 - RNA, 81 nt, Homo sapiens
ccuucaguaugcacugagcuaguagcauugugucauggaugcucacugagccugugcagcuaguacaagguaagcugaagg

SEQ ID NO: 2243595 - RNA, 91 nt, Homo sapiens
cuaaguguucucagguaaagcugucaaggcaggaggcugagugaggacacaccagcuuuaccugccuuggggcacuccugggauugauugg

SEQ ID NO: 2243596 - RNA, 64 nt, Homo sapiens
aagaugauguuguguuuucacuuuguuggugugaauaguugagugaaaauauccaacucauuuu

SEQ ID NO: 2243597 - RNA, 93 nt, Homo sapiens
cacuccucuaucaucuuggcuuuucauccugggacauuaagugugagcagaaaagugucacauaggggugaagauacaaucuggugaggggug

SEQ ID NO: 2243598 - RNA, 86 nt, Homo sapiens
augucuuugcuaaugugaauagugcuguaaugaacauaagcauacaugugucuuuaugacagaacgauuuauauuccuuuggacau

SEQ ID NO: 2243599 - RNA, 108 nt, Homo sapiens
aauguuuucuuuaggcauagauuggugcauguauuuuaaacagaguuguauuuuauauacuguuuauaaccuguaaccauaugaucaguuuccaugucuuuaaauauu

SEQ ID NO: 2243600 - RNA, 83 nt, Homo sapiens
cagacucccaggcccacuagaacuagaacugcugggguaggaccugcccacaagcaucuuuuuagccuucucuggugauucug

SEQ ID NO: 2243601 - RNA, 55 nt, Homo sapiens
ugaguugagaggagccugaagauagaucuggauggucaggcuccgcauuaacuua

SEQ ID NO: 2243602 - RNA, 77 nt, Homo sapiens
cucccauuuccuaauuugauuucaccgcucugcaaugaagucagaauuagagccacauuaaauaugggaagagggag

SEQ ID NO: 2243603 - RNA, 66 nt, Homo sapiens
gugcuguuugucaggacacgaguucuugagaacuaggagucgguguuacugacagaaugugagcuc

SEQ ID NO: 2243604 - RNA, 62 nt, Homo sapiens
uaggacacaggacauauguagagauuaaauagaguagguggugcugugugccuguaguccua

SEQ ID NO: 2243605 - RNA, 84 nt, Homo sapiens
ggaaugccagugagagagaaccguuuacucccuuggaaaagaggcugaagccagggagcaaaguggucuuucucaguguauccc

SEQ ID NO: 2243606 - RNA, 84 nt, Homo sapiens
caagcaucucuguccacauugcucuuaccaaguuugucacaccugaagaccaggccuaggagcaauaugacaagaggguccuug

SEQ ID NO: 2243607 - RNA, 63 nt, Homo sapiens
augcuuuaguuaaaauugggguugucugcaguuaacagagaccccgaauaauugacuuaacau

SEQ ID NO: 2243608 - RNA, 82 nt, Homo sapiens
agggacuuuauucauucuuucacagaagagaaaaagagaaaaauaugucuauuccauuugugaaaggaaguguaacuucccu

SEQ ID NO: 2243609 - RNA, 77 nt, Homo sapiens
caagacagcaauccuugaggucuuugagcaaacgcaagaaccguccuucuccugcugcuggugaccucugcugcuug

SEQ ID NO: 2243610 - RNA, 73 nt, Homo sapiens
ucugugcauguaugcgugaguucgcauguuugugugucugaguaagcucacguuuuacauguaugugugcaga

SEQ ID NO: 2243611 - RNA, 79 nt, Homo sapiens
cagagcuauacauccauuugcuuuauuugcugaucuuuugaagauguuacuaguuguggagaagugauguauuguuuug

SEQ ID NO: 2243612 - RNA, 62 nt, Homo sapiens
ggucagaaaagacacuugauaugauuucaauguuuaaauuuguuaagauguguuuuguggcu

SEQ ID NO: 2243613 - RNA, 60 nt, Homo sapiens
ugucuggaguaugaaccauguaucagcaccgaaagguucuagaagucagacuuucgggca

SEQ ID NO: 2243614 - RNA, 84 nt, Homo sapiens
gguuguaugaacuugaaaaaucccuugcucucucagacccucaguauggggucuggaaaaauaagggggacauacucaauagcc

SEQ ID NO: 2243615 - RNA, 108 nt, Homo sapiens
agccaaaaaugucuggaaggauguuuagauaguaaagccauuagcuuauaugauuaaaaauaugaaagaaaaugaaucugcuuuuggacauguugagauaaaaagguu

SEQ ID NO: 2243616 - RNA, 65 nt, Homo sapiens
augagauuugggaggggccagucggggaaugauaugguuugccuuuguccccacccaaaucucau

SEQ ID NO: 2243617 - RNA, 68 nt, Homo sapiens
uuagugugcaaguauuaaucaucuagccaauaaugaccaaaucuaguugaaaugcaugugcacauuaa

SEQ ID NO: 2243618 - RNA, 77 nt, Homo sapiens
agagucugaguucuuuagcaaggauauggggauggggaaguaauuuauauccuuauuuguuaaaaugcacagauuuu

SEQ ID NO: 2243619 - RNA, 71 nt, Homo sapiens
aggucauagguagauuuaaagauuuucugauuagcaauugguugaaagaguuaagcuuugccuaaagacuu

SEQ ID NO: 2243620 - RNA, 74 nt, Homo sapiens
caguguuagcacagagcuuuuaaacuuccgcacugcugaugagggagugugauuguucucuguuaccagcacug

SEQ ID NO: 2243621 - RNA, 75 nt, Homo sapiens
cuggauuugguuagccaguauuuuauugaggauuuuugcaucaauguucaucaaggauauuggucugaauuacag

SEQ ID NO: 2243622 - RNA, 67 nt, Homo sapiens
gccaaugccuggcaugcaugcauucauucauucacugauaggauuuugcuauguuguccaggcuggc

SEQ ID NO: 2243623 - RNA, 59 nt, Homo sapiens
gauggcauuucuggaucugacagcucuuaucauaaugaagguuugaaagaaaugucauc

SEQ ID NO: 2243624 - RNA, 92 nt, Homo sapiens
guggauuaucuuuuugauauguuguuggauucgguuagcuaguauuuuguuaacaauuuuagcaacuauguucaucagagauauuggucuau

SEQ ID NO: 2243625 - RNA, 56 nt, Homo sapiens
uaaagcuacaguauaugguauugcuauaaugcaauauugaagauaaugugguauua

SEQ ID NO: 2243626 - RNA, 86 nt, Homo sapiens
aguaauaggaccaaaugaucacauuuauaguggcacgcauaguaguuuaugaguggcaguauaugugugaguguuuccuuugugcu

SEQ ID NO: 2243627 - RNA, 70 nt, Homo sapiens
agcaauaaugauguguguuuaagaugucuguuauaacacagacagccuuaaacuacacaugucuuuugcu

SEQ ID NO: 2243628 - RNA, 97 nt, Homo sapiens
guggcauagugcgcauggugagaagaugucaaauuuucaauaaaauuugaagguggaguugacaauuuucaacagaucagaugugagguauagcuac

SEQ ID NO: 2243629 - RNA, 79 nt, Homo sapiens
acaggucugcaucaccauggugggcuaauuuuuaaauuuuuuucuagagguagggucccacuauguugcccaggcuugu

SEQ ID NO: 2243630 - RNA, 58 nt, Homo sapiens
uuuaaagcuccaagcaugucuggcauauaguaugcaaccaguaagugcuaguuuuaaa

SEQ ID NO: 2243631 - RNA, 71 nt, Homo sapiens
uuacugucugagggcuccauuaaaucaccucagguuccuugagaugauuuaauggagcccacagacacuaa

SEQ ID NO: 2243632 - RNA, 63 nt, Homo sapiens
ccagggcaaucaguagauguucuuucauacaauacagcuuagggagcaucauuauuguuuugg

SEQ ID NO: 2243633 - RNA, 79 nt, Homo sapiens
accuguagaaguuggcauucuggccaguuuggaaguuaugccaacccucugugaacuggcuuagugaaacuucccaggu

SEQ ID NO: 2243634 - RNA, 66 nt, Homo sapiens
uugccuuuuauuauuauuuuuuauuaaguuugcaaggacuaugugaaacuggguggugagagacaa

SEQ ID NO: 2243635 - RNA, 64 nt, Homo sapiens
auugugaauagugcugcaauuaacauaugugugcaugugucuuuauagcagcaugauuuauagu

SEQ ID NO: 2243636 - RNA, 60 nt, Homo sapiens
ucugccacugacaccucaaggaccauuggaucuccugggucauagggcucaaguggcaga

SEQ ID NO: 2243637 - RNA, 89 nt, Homo sapiens
ggagaauugcuugaacccaggauagggagguugcagugaacugagaucgugccauugcacucuagccugggugacaagagcaaagcucu

SEQ ID NO: 2243638 - RNA, 97 nt, Homo sapiens
ggagauaacaguucaccaacuaugugcacaugcccuggugacuguaucccacuauguggcaccagguuguguguuuauuugccgaggcucuuucucc

SEQ ID NO: 2243639 - RNA, 94 nt, Homo sapiens
ugaggaacugcuaugcuauguguuugaguugguuugggcuguuguaacaaaauagcacacuggguggcuuaaacaacagaaaugcauuuucuca

SEQ ID NO: 2243640 - RNA, 57 nt, Homo sapiens
uggaugugacucuagagcugccuguggccguguuccuggccaccuggagaaaauuua

SEQ ID NO: 2243641 - RNA, 129 nt, Homo sapiens
ccucgacuuaccauggauauguccagauaaacccaugguaagcugaaaauaucgaaaacacacuuuugacuuacgguauuuucaacuuacauuggauuuuucgggacaugaccccaugcuaagucgagg

SEQ ID NO: 2243642 - RNA, 87 nt, Homo sapiens
ucucaagcugugggucugcaaagggaagcccuuucuguugucuaaaagaagagaaagcgcuucccuuugcuggauuacgguuugaga

SEQ ID NO: 2243643 - RNA, 70 nt, Homo sapiens
uaguuguaugccacagaaauaaccaaaauuuccuugucaauugugguuuuaaucguggcuguccuaacua

SEQ ID NO: 2243644 - RNA, 69 nt, Homo sapiens
ucuacauggguguuuuagcuacugaauuaagaacgauuugaugacagugaguaaccccaacauuguaga

SEQ ID NO: 2243645 - RNA, 66 nt, Homo sapiens
cuuuugaucucccauugugguuucccauugguucaacccaaucacaguuaguaagggagaaaagag

SEQ ID NO: 2243646 - RNA, 70 nt, Homo sapiens
uguggggagggaggggugcccaaggagccacuggaguuuuaggucugaggugcaacucccucucccuaca

SEQ ID NO: 2243647 - RNA, 80 nt, Homo sapiens
caucucugaggauauuucuggaggacauugacaugugagucaguggacuaaauggggaauaucuacccucaauguagaug

SEQ ID NO: 2243648 - RNA, 74 nt, Homo sapiens
agucuuuguguuuucuagguuuuaacacauagguuuucauuuaucuugaguagauaccuaggaauagaauugcu

SEQ ID NO: 2243649 - RNA, 57 nt, Homo sapiens
aggcuguaguguguagugauugcaccuguaaauagcuacuacugcacucuccagccu

SEQ ID NO: 2243650 - RNA, 99 nt, Homo sapiens
gaggcgggaggaucacuugagccugggagguugagacugcagugagccgugaucacuucacugcauuucagccugggcaacagagugagauccugucuc

SEQ ID NO: 2243651 - RNA, 63 nt, Homo sapiens
auuggacuugaagaccuggcucuauggagagaggaaaaauuaucaggcuuuuugagugccaau

SEQ ID NO: 2243652 - RNA, 84 nt, Homo sapiens
gagguaaugagagcuaacauugauucagugccugcuauguuuugcacuguuagguacuuuacauguuaucucauguaauaccuc

SEQ ID NO: 2243653 - RNA, 73 nt, Homo sapiens
ccaaagugcugguauuacaggcaugagccauggcgcccggccaaggccacaccucuuaaugccauuaccuugg

SEQ ID NO: 2243654 - RNA, 81 nt, Homo sapiens
gcggggcuguggacuagagggugggcgagguggccuggcugugcccucaccagcccauguuuuacucccauugugccuugc

SEQ ID NO: 2243655 - RNA, 125 nt, Homo sapiens
accagugguagggucagggacugagaguaggggaaugagucccugaggaacauccagggcuguggguaugacagcugaagucacucagggguccccagccaucugggaccuggaagaccaaaggu

SEQ ID NO: 2243656 - RNA, 113 nt, Homo sapiens
cagaguucagagcccuuaagaaauuugaggcuaaaaucugauugacaagguuauuucauuuuguaaauugagcauugguauagguuuuaguuuguuuaugggaucugauucug

SEQ ID NO: 2243657 - RNA, 61 nt, Homo sapiens
guuccaguauuugggcaagcgcaucguaacggaaaccagugccuugccugugugcugcaac

SEQ ID NO: 2243658 - RNA, 69 nt, Homo sapiens
gugacauuuaaagcuggcguuacaguuuguagguuuuacaaaucauggcucuagcuuacaaauguacac

SEQ ID NO: 2243659 - RNA, 72 nt, Homo sapiens
cuaaccaagauggcuuuggucucccagugauuuauuuguuaaguccuuggaguuccaaagccaauugcuuag

SEQ ID NO: 2243660 - RNA, 68 nt, Homo sapiens
cuucauaaucaugucugaaaccuuugauauacugaguuguaaacagugucuuuggacaagauuugagg

SEQ ID NO: 2243661 - RNA, 56 nt, Homo sapiens
gagauggggucucgcucuguugcccagauuggaguacaguggugugaucucagcuc

SEQ ID NO: 2243662 - RNA, 73 nt, Homo sapiens
cuccuaggguguaauacauuagcaaaccaaagaaucaaagaucuuugcccuuguggaguuuacaugcuagggg

SEQ ID NO: 2243663 - RNA, 108 nt, Homo sapiens
aaauuguaaugcugauguaaagauguagaaguaaggggauguuguaaaauaugucauacuauuucaugaauguuugcuuacuuccauaauaucagaauauaucaauuu

SEQ ID NO: 2243664 - RNA, 123 nt, Homo sapiens
gcuuuauggccaagugugugguugauuuuagagcaugugccauacguacauaagaagaauguauauucuaccguuguuugauggacugcucuguaguugucuguuaguuccauuugguaaagu

SEQ ID NO: 2243665 - RNA, 65 nt, Homo sapiens
acuggauguuagggauuuuauuguaucacuuccaaaauguauauguugaaguccuaaccuccagu

SEQ ID NO: 2243666 - RNA, 76 nt, Homo sapiens
uggauauaauagaaugucaguauuggcuaaaaucguccaauguuucaggcucucuggucauucaaauuuuugucca

SEQ ID NO: 2243667 - RNA, 74 nt, Homo sapiens
ucccgcagcucuucagagugagcaaugccaguuucuugaaugcuauugcugaugcugaagggaagucacaggga

SEQ ID NO: 2243668 - RNA, 57 nt, Homo sapiens
ugacuaaggaaggauuaugugcagagacuuguucucgcauagauguuucuucaguca

SEQ ID NO: 2243669 - RNA, 85 nt, Homo sapiens
uggaucauauuauugaaaguugucaacaugaaacuguguuuuugaaaucaaaagugguuaaauauuggcaaucacaugugguuca

SEQ ID NO: 2243670 - RNA, 92 nt, Homo sapiens
ggagugcgagugcucagcccauguuagcaugcauacuuauuuuuaaagguguauguuguccauggaugcguaacagauuuccucagugcuuc

SEQ ID NO: 2243671 - RNA, 109 nt, Homo sapiens
ggccugugguaggaagcuuuggagcaguuagggcaaugggaccauuuguucacacaaacaucccugaguaucuaauguguuucugaguuuccuagcagaaauccaggcc

SEQ ID NO: 2243672 - RNA, 58 nt, Homo sapiens
gguguagguagugucagugaguggcucuugugccugcuguagacauuaggccugcacu

SEQ ID NO: 2243673 - RNA, 91 nt, Homo sapiens
gucuccaccugagcuaagaauccagaccaagugacagguguacccagucaacacuguauacauuggcuagguuuggaggcacaguggggau

SEQ ID NO: 2243674 - RNA, 77 nt, Homo sapiens
ggguuguagugaggguuacgugaacauucauauaaaacaacuacaacaguguucaguaaauguucuuacuauagcuc

SEQ ID NO: 2243675 - RNA, 76 nt, Homo sapiens
uuccuauucauuuuuaaacucaaauuauagccaacauuuuugcuuuuaggcuguaagcauuauaaagagauaggga

SEQ ID NO: 2243676 - RNA, 67 nt, Homo sapiens
ucuucuauaucuacauaugcaaagcuuuccuuaacaguaaaggguacauaugcauagugggaggaga

SEQ ID NO: 2243677 - RNA, 67 nt, Homo sapiens
uugaggaggcagucugacccuuagcagagcuugaaugcucugcugggagguccgcugcucucuucag

SEQ ID NO: 2243678 - RNA, 59 nt, Homo sapiens
aguggcaggcagaccacagaugacuuuccaguuuuguuauuugguggcugugugacacu

SEQ ID NO: 2243679 - RNA, 63 nt, Homo sapiens
gauacaccauuuucuagcuauuagauucgcaaggauauuacugaguuggcaagguugugaauu

SEQ ID NO: 2243680 - RNA, 74 nt, Homo sapiens
gacaacaaugaaguuugcuacauugauugccucuuucuuucgugaaagauuucucuguagcacuugaugcuguu

SEQ ID NO: 2243681 - RNA, 89 nt, Homo sapiens
ggagaaucgcuugaaccugggggucagagguugcagugagccgagauugugccauugcacucuggccuaggugacaagaauaagacucc

SEQ ID NO: 2243682 - RNA, 61 nt, Homo sapiens
auauuggacucugugcuaggaaauguaaaucuuaauaagucuuaaaaacagaauccaguau

SEQ ID NO: 2243683 - RNA, 79 nt, Homo sapiens
ccucuuggggauucugaugcaugcucagguuugagagccacuguucuggugacugagauggguucugguccccugacgg

SEQ ID NO: 2243684 - RNA, 78 nt, Homo sapiens
aguccugguccaaguaauuggcggggaguuuagacaauugugcaaccuggaugucuuugccaugcaugugucaggguu

SEQ ID NO: 2243685 - RNA, 60 nt, Homo sapiens
cugaucuaugaacacaggauaucuuucuacuuacucagauuuuccugaugcauacaucag

SEQ ID NO: 2243686 - RNA, 123 nt, Homo sapiens
guuaagagaccaggccggcuccggcuggaaguggguguguccuacugugugcugccgcaugcaugguggcaccucuggaugcauucaacuuccaguucucugcagugccagguaccuagugac

SEQ ID NO: 2243687 - RNA, 121 nt, Homo sapiens
gugagauauuagaaaagaaauuggugguaguuggugauugauugggucugugguaauauucuaggcuuuggaucacccugccagucaccaaauccaauagauuuuuuuuuuuuuuuuuuac

SEQ ID NO: 2243688 - RNA, 72 nt, Homo sapiens
uauauucugcuaccuugaugaauucguuuauagaugguuuuaucacagauucuccaggguuuuccagguaua

SEQ ID NO: 2243689 - RNA, 63 nt, Homo sapiens
gggacuguuggguaggagaacugaaaacaccaagcauguuggcaucacauuacucaaaguccu

SEQ ID NO: 2243690 - RNA, 71 nt, Homo sapiens
ggagcuugaaagugauguccaggcuuucaggcuaauugcuggaaagccccagucauuuucuaaaaaguuuc

SEQ ID NO: 2243691 - RNA, 77 nt, Homo sapiens
aggaaggagcuuuauucggcuaggagcuucggcaggcuugugucccaaaagccgagcuccccgagugagcaauuccu

SEQ ID NO: 2243692 - RNA, 70 nt, Homo sapiens
aaaguugagguggauacauuaaauaaugcucacuuuauuugagcaagauuuaagagucagccuugacuuu

SEQ ID NO: 2243693 - RNA, 66 nt, Homo sapiens
gggaagugugcagaguucucuuagaacacccagucacaugguguagagacugcucuuacacuuccu

SEQ ID NO: 2243694 - RNA, 126 nt, Homo sapiens
uauucccuugggucuguggugguggucaugaggugaggcuucucuggcuuuagaaagaggagggaagagugggaaggacuacaucuuaugauuuaagagccaucucagccacagugcaagagaaua

SEQ ID NO: 2243695 - RNA, 67 nt, Homo sapiens
guuuauuacaguagaugaggguauaaugguacaagcugucacaauaccauucauuuacucaacagac

SEQ ID NO: 2243696 - RNA, 114 nt, Homo sapiens
gacuacagggagaccucugucaugccucuggucccagggccaugacuccagauacuggcucuuccggagccauggcccugggaaaggaggcauggcagaggugucccuguaguc

SEQ ID NO: 2243697 - RNA, 71 nt, Homo sapiens
auuuggguagacauguuuuuuaagguuuaugaaaaucucuuuuauucccaguuaaacauguucaucuaagu

SEQ ID NO: 2243698 - RNA, 82 nt, Homo sapiens
cccagcuuggacuaauuccaccuucuuccugugauuaguguagaauugacaagaguagagagggugccagguccagguaggg

SEQ ID NO: 2243699 - RNA, 106 nt, Homo sapiens
guaccuagaguagucaaauuaugucuuucauagagacccagaaaguagaaugaugguuaucaugggcuuaggagauggaagaaugggauuauuuuuuacaggguac

SEQ ID NO: 2243700 - RNA, 88 nt, Homo sapiens
cuuuccugaggcuccgcuccuugccccaccaugugacugccaugugagcagugaccacagaaagugagggagcaagugaucagggagg

SEQ ID NO: 2243701 - RNA, 92 nt, Homo sapiens
guguauuaaagagcuugaccacugggcacaguaagugugccugagaagaggagaacuacuaauugugcuuaugguuuuguucuuagauauac

SEQ ID NO: 2243702 - RNA, 66 nt, Homo sapiens
gaggaauugcugcuccagaggucagcaugguggagacaacaagcaucacuggaggcagccaucuuc

SEQ ID NO: 2243703 - RNA, 130 nt, Homo sapiens
guguccaacuuuucucucauugagcagguuuaugaauuuuauccaggauauaugcuugguuuuuuguauuccugagcuguauuuuguucuaaaagcuauacaauuaguucauuuucuuauugauggacau

SEQ ID NO: 2243704 - RNA, 90 nt, Homo sapiens
cacugaaaugcuucuuuugauaggucagaugauauugaaacaaacuagaauucuguuuccugucugacuuguggaauugcaguaucagug

SEQ ID NO: 2243705 - RNA, 65 nt, Homo sapiens
cauggagcuaggcuugaucccuggucugcauggcuuuagagccuggggucaagguggcugccaug

SEQ ID NO: 2243706 - RNA, 58 nt, Homo sapiens
uggaaguaagcuaccuccaggacagaaguacaaucuugugagagguaguuuacuuuca

SEQ ID NO: 2243707 - RNA, 56 nt, Homo sapiens
gagauggaguuucacuucgcucuuucgccaaggcuauagugaaguggcucgaucuu

SEQ ID NO: 2243708 - RNA, 66 nt, Homo sapiens
uaucaagauggauaaggauagacuucuaggguuugaaucucaguucuauaccuuacuaucugggug

SEQ ID NO: 2243709 - RNA, 88 nt, Homo sapiens
ugcccauuggcuuauagauuaucuaugugcuuucacuaaugcaugauagcuuaguaguugugauagguaccuuguaggccacaaagca

SEQ ID NO: 2243710 - RNA, 119 nt, Homo sapiens
uguaugaauaauuuguuccuuuuuauugcuaagcagcauuccacuggauaaacaagguaugguauagccauauaguggaauacuucuuagcaauaaggaaagacauauugacacaugca

SEQ ID NO: 2243711 - RNA, 56 nt, Homo sapiens
uucagugucauuaacacaguagugggugcaaaacacagaacuguuaguacacugga

SEQ ID NO: 2243712 - RNA, 61 nt, Homo sapiens
ggcuggacuuggaggagaucucgcuguggagcgcgaaugaguucuuccaccgggaccagcu

SEQ ID NO: 2243713 - RNA, 64 nt, Homo sapiens
uucaguaguacauucccguguucugucaaacuaaagauucugaacaauagaauaugcuaaugaa

SEQ ID NO: 2243714 - RNA, 129 nt, Homo sapiens
agauagcccgucagagaggccaaacacagacagguuucgcuuggccuccuggucauauccagcaugcuuugauacacuggaggagcaggaggccgaggaggcggcggccgcuaucugagggagcugucu

SEQ ID NO: 2243715 - RNA, 58 nt, Homo sapiens
ugagaccgagucuugcucugucauccaggccagaguacaguagcgcaaucucggcuca

SEQ ID NO: 2243716 - RNA, 91 nt, Homo sapiens
uccuucaguuuucaucuauauuuauuugcuuuucauggcaaaggaauuucuucuuggccaugaauggcaaggcagaaugaaaaauauugga

SEQ ID NO: 2243717 - RNA, 113 nt, Homo sapiens
gagguacuaacgcacuacauuuuugaauuacuauugauugacaugucucuguucaauguaaacagcuuaaacagagagugcaguuauagaaauggaauuugcaugagaaccuu

SEQ ID NO: 2243718 - RNA, 74 nt, Homo sapiens
gaagaugcauuaagggccuggagauacacuggucaacaagacaaguauggugucuccugccuucaugcagcuuc

SEQ ID NO: 2243719 - RNA, 72 nt, Homo sapiens
ugucaguauuugguagaguucgauaccuguaacucacugaaacagcaguuuccgacucaccaacaccugaca

SEQ ID NO: 2243720 - RNA, 86 nt, Homo sapiens
agagcuggaaaauuaaugugaaucaggaugcauuugguguugacauuuauaucuuaguguaauuugacucaauguuaauccucuuu

SEQ ID NO: 2243721 - RNA, 92 nt, Homo sapiens
uguuaauuggcuugugagagacacacucaaauguucagacucuuaacagguaaugagccuugacacagugaagucucuacuugcaguaaaca

SEQ ID NO: 2243722 - RNA, 62 nt, Homo sapiens
uuuguacacgugggugaauuguuuuaggauucaaacuacuaccuauucaacauguguccaga

SEQ ID NO: 2243723 - RNA, 103 nt, Homo sapiens
aggcaacagcuggggagcccuccuucacucuacaucuuuguucugcucucuuuuccauccccaaagaaacagaggaggaggaagcagagcccccaucgcgccu

SEQ ID NO: 2243724 - RNA, 72 nt, Homo sapiens
cuguugaaauguuaauuccauuguuggaugccacagcugugagcauuacucaugggaucaacauucuauuag

SEQ ID NO: 2243725 - RNA, 57 nt, Homo sapiens
aggaggaaggggaggaugguuaacuggaagcaacuauuuguccugccuuuuccuccu

SEQ ID NO: 2243726 - RNA, 77 nt, Homo sapiens
cagagaagauaugcauauauuuauacauuuauguacauaacaucacuguguauguauaugcaggguguuuuacuuug

SEQ ID NO: 2243727 - RNA, 116 nt, Homo sapiens
ucucccuauuuuguuccaaaauuggucauacaccuucugauauaugagaaguacacccagucccuggucuagagguagguguaugaacuaguucuggugaaugaacgugugggaga

SEQ ID NO: 2243728 - RNA, 86 nt, Homo sapiens
aaaccuuguuucuuuaugguuuucucuuacguguuguuguauuggauggcaacucugugaguaagauuacaaugaaauagagguuu

SEQ ID NO: 2243729 - RNA, 81 nt, Homo sapiens
ccaguguguaugguuggcagguaaggagugggagccugguucgccagcccugacuccuugccuccuccugggagucacugg

SEQ ID NO: 2243730 - RNA, 68 nt, Homo sapiens
uugcucaggcuggaguacaauggggcaaucacagcucacugcagccuugaccucccagacuugagcaa

SEQ ID NO: 2243731 - RNA, 120 nt, Homo sapiens
guccccaauauuuuacaguguggaccauaggguagcugaucagaaucagaagggggcuucuugacacugcaguuuuccugggucccacccucuauauucucaauaaaaaucacuggggac

SEQ ID NO: 2243732 - RNA, 71 nt, Homo sapiens
acaugugguaccugauacaggcgcacgguguucauggagcacgugcgguaccugauacaggcgcaccaugu

SEQ ID NO: 2243733 - RNA, 64 nt, Homo sapiens
ccccagugcucuucacacugguuuaggauggagacauauauggauaguuuacugaagagugggg

SEQ ID NO: 2243734 - RNA, 68 nt, Homo sapiens
cucuggguauuugggauggguuuggggggcaaccgccugcaacucaauguaucuccaagaauugagag

SEQ ID NO: 2243735 - RNA, 55 nt, Homo sapiens
gcuacaaauauauguaugcaagucuuuuguugacauguuuucauguauuuggagc

SEQ ID NO: 2243736 - RNA, 84 nt, Homo sapiens
ggcuauuuucacuucuuuuguggaucuucuguugcuucgggccaucuggauguauacgugcaggucacaggggauaugauggcu

SEQ ID NO: 2243737 - RNA, 60 nt, Homo sapiens
uagaauuauauccuguuguccuaugacuucuaagccaagggcacuauagauguuauucua

SEQ ID NO: 2243738 - RNA, 91 nt, Homo sapiens
gagugagacaagacaaagaaguggaggggaagcugugcgauuuugggcauggauugcacagucuagcuccaccuuuuauuuuauuuuauuu

SEQ ID NO: 2243739 - RNA, 72 nt, Homo sapiens
acuugagccugggaggcggagguuguagugagcuaagaucgcacuauugcacucuaaccuaggugacagagu

SEQ ID NO: 2243740 - RNA, 60 nt, Homo sapiens
uaugacauaguccuuaacccuccuccccacccugggagcaaggaagagauuaugcccaug

SEQ ID NO: 2243741 - RNA, 60 nt, Homo sapiens
gugacucgagggcauaagagcuuuucagucccuggcaaauuucuuuugcuguugaguugc

SEQ ID NO: 2243742 - RNA, 84 nt, Homo sapiens
agaagugcuaaaugcaugaggcgaugugcuaauuaccuugauuugaucaucccguauugucuauguguauuggacuaguacucu

SEQ ID NO: 2243743 - RNA, 56 nt, Homo sapiens
acaggaggauggcagcagguugguggaacaggacuuuucugugcuugucccccugu

SEQ ID NO: 2243744 - RNA, 75 nt, Homo sapiens
ucuugguuaucucuuuucauguguaaaugagguucuagguugaacaguauugguaucugagacagaguuucaaga

SEQ ID NO: 2243745 - RNA, 99 nt, Homo sapiens
gaggcaggagaaucgcuugaacccaggaggcggagguugcagugagccgagaucacgccauugcacuccagcccugcugacagugugagacucugucuc

SEQ ID NO: 2243746 - RNA, 64 nt, Homo sapiens
uucgguuugccaguauuuuguugagaauuuuuguaucgaaguucaucaaagauguuggccugaa

SEQ ID NO: 2243747 - RNA, 61 nt, Homo sapiens
ucaguauguaguaugaagaagaugcuugcucuguaagugugcacucuaggcuagauauuga

SEQ ID NO: 2243748 - RNA, 76 nt, Homo sapiens
ccagucgugacgucauuguuccuggcuccugggggaaauggaucgggggccccagccgugacgucauuguuccugg

SEQ ID NO: 2243749 - RNA, 90 nt, Homo sapiens
uaucauauucuauauugucuacauuuagccacagguguuaacaaaaugauaagcaccuggaaaguagacaaucuaaaaauuguaauggua

SEQ ID NO: 2243750 - RNA, 91 nt, Homo sapiens
uggagagaaggagguuccucugacuagaggaucuuagggggcugaggugcaggcuguuaagguuuuuguagcaaggaugucuucagcuuua

SEQ ID NO: 2243751 - RNA, 68 nt, Homo sapiens
cuugucagcaguggacagaaugguaggcucuagaucuuagacuaucuagcaaauucacugcccacaag

SEQ ID NO: 2243752 - RNA, 69 nt, Homo sapiens
gcuuauccuucucauguaaggguauaguaaggaaauaaucuuugagaucuacuacuguaggaggugagu

SEQ ID NO: 2243753 - RNA, 72 nt, Homo sapiens
agacuuuuugauguaggcauucaaggcuaugaacuuucuucuuagcacugcuuuugcugcaucccagaguuu

SEQ ID NO: 2243754 - RNA, 73 nt, Homo sapiens
uccuacuuuaugauaucugcaaaucaaguauugccaagcuggacaacauauucacagguaucagagauuagga

SEQ ID NO: 2243755 - RNA, 61 nt, Homo sapiens
uccugagaagcauaccagugucuguugaccuagcaacagaguguaggaauguauuccagga

SEQ ID NO: 2243756 - RNA, 59 nt, Homo sapiens
ucagcagugugaaaauggacuaauacaguaaauuuguaccaggagugaggcacugcuga

SEQ ID NO: 2243757 - RNA, 104 nt, Homo sapiens
ugagcaugguggugcuugccuguaguuccagguacucagggggcugaggcaguaagaacacuugagcccaggaggccugggugacagaguaagacccugucuca

SEQ ID NO: 2243758 - RNA, 89 nt, Homo sapiens
ggagaauugcuugaacccaggaggcggaagguacagugagcugagaucacgccauugcacuccagcucugggcgacagagcaagacucc

SEQ ID NO: 2243759 - RNA, 105 nt, Homo sapiens
ucuggcuugguuucuaagagcuuuuuggcuuuuaugcagcuuagguggucuauuucaucuagauuagguauaagagcuucaaaagcuaauggcagggcugccagg

SEQ ID NO: 2243760 - RNA, 97 nt, Homo sapiens
gugauucuccugccucagccucucaaguacaugggauuacaggugcgcgccaccaagcccaucuaauuuuuguauuuuaguagagacgggguuucac

SEQ ID NO: 2243761 - RNA, 71 nt, Homo sapiens
ucagaguaaggaagaaggaauaucacggacaucuuuaugggucauggugagaacuuugucuuuuacucuga

SEQ ID NO: 2243762 - RNA, 69 nt, Homo sapiens
uuugcuguuugguuggcuuagccauuccagccuuugggcuuuggaaaguccaagccaaccgggggcaga

SEQ ID NO: 2243763 - RNA, 55 nt, Homo sapiens
uauuucaguugcguuucccgaguagccccagcaacaggagaagcaucuagaaaua

SEQ ID NO: 2243764 - RNA, 76 nt, Homo sapiens
guagcuuuuaauaugucuugaaauuggguaaucuaagucuucaaagauuguuuguuuucaagauuguuuuggcuau

SEQ ID NO: 2243765 - RNA, 121 nt, Homo sapiens
uacaggaagaagagaaaucaaacuaggcugugauuuguauuaaaagugugacgugaaggagggcuuagcuucaacaaugagauaagaaacaucaggccuggugugguggcucaugccugua

SEQ ID NO: 2243766 - RNA, 81 nt, Homo sapiens
ggguaaguagcuuuagauauaaauacugaaauaauuaaaaaucaaauuaauuuaugucugggguuugcuuuaaaauaaccc

SEQ ID NO: 2243767 - RNA, 62 nt, Homo sapiens
gguguacugagagacaguuacuguuaguauuuuugcaagcaguaaagggaucuuagaacacu

SEQ ID NO: 2243768 - RNA, 87 nt, Homo sapiens
cugggaaauuuaaguuugcagaucccacacucacccugaauccucacucaggguggggucaggaaucugcauuuuaacuagucgcgg

SEQ ID NO: 2243769 - RNA, 57 nt, Homo sapiens
gaggcuggaggguuccaggaggccaccccaccaaggcugccugacacucuuugcuuc

SEQ ID NO: 2243770 - RNA, 59 nt, Homo sapiens
uuuuccucuauguguucuucuaaaguauaguuuugcaagauguuaacauuggaggaaaa

SEQ ID NO: 2243771 - RNA, 65 nt, Homo sapiens
uggaguauuauguaauuucaauuugacaugaaagcgauugguuuuggauuuuacaaaguacucca

SEQ ID NO: 2243772 - RNA, 61 nt, Homo sapiens
ggucuuugguucuguuuauaugcuggauuacguuuauugauuugcauauguugaaccagcc

SEQ ID NO: 2243773 - RNA, 67 nt, Homo sapiens
uaauuuugucauuuucagaguguuacgugaaucuuucaguauguaaccuuuuggaauuggcguguua

SEQ ID NO: 2243774 - RNA, 60 nt, Homo sapiens
aauccuaauuccuaaugugauguuucuuagagguggagcccuucacagguaauuaggauu

SEQ ID NO: 2243775 - RNA, 116 nt, Homo sapiens
uugaucauugagcuuucugcagguggauaaguuugucacuggaucacuaauguugugcuguuauugcuccagaggcugauuuuauuguucaguccaucaaaagaggcugugguuaa

SEQ ID NO: 2243776 - RNA, 65 nt, Homo sapiens
gauucaagucucaauguauuauggugagcaaaagagggccagcaagaugaaguugagcuaggauc

SEQ ID NO: 2243777 - RNA, 88 nt, Homo sapiens
aggaccaaccuuccccucuuuaugauugacacuggcuuguuucagauaggucagugcauucuaaaggcaaaugaacaacggcaguccu

SEQ ID NO: 2243778 - RNA, 77 nt, Homo sapiens
ucacuugaacuugggaggcggagguugugaugagcuaagauagcgccauugcacuccagccuuggcaacgagaguga

SEQ ID NO: 2243779 - RNA, 56 nt, Homo sapiens
uugauagaucagggauuugauuuuuuaaaagagagaaucuaacaccuuucuaucag

SEQ ID NO: 2243780 - RNA, 57 nt, Homo sapiens
gagccaggagaugcaggaagacuggguccuucgcccuucacuggagucccuggauuc

SEQ ID NO: 2243781 - RNA, 56 nt, Homo sapiens
ccccauuguugugguuuuaucuaccuuuggccucugauggugaccuacagaugggg

SEQ ID NO: 2243782 - RNA, 64 nt, Homo sapiens
auauugaacacagaguagcuuuccaaacccauggaguauggauccgcuuucccugugucaauau

SEQ ID NO: 2243783 - RNA, 64 nt, Homo sapiens
gugagaaugaugaguuucagcuucauccaugucccugcagaggacaugaacucauucuuuuuau

SEQ ID NO: 2243784 - RNA, 102 nt, Homo sapiens
cccuacacgucagagagaugugggauuuugccaggugccaaguaugucuaugccaguuguacauuuuggcacugggaaaaugaccacggaaugacucugggg

SEQ ID NO: 2243785 - RNA, 101 nt, Homo sapiens
gggugccgaccugcagagcucuugccgcagguguuaugcaaacaacuggggccaccgcagugugugcauggcccugccuuguacucugagagcucggcccc

SEQ ID NO: 2243786 - RNA, 64 nt, Homo sapiens
cuccacuccuuucaugaagucuuccucacaagaguagaauaauauuuucaauguaaggauggag

SEQ ID NO: 2243787 - RNA, 90 nt, Homo sapiens
ccaggcuugaucgagaaaugagaaacccauuuuacaggugaacuaaaaugagauagguauuucauuuacccuuuuacaaaggccaaaugg

SEQ ID NO: 2243788 - RNA, 90 nt, Homo sapiens
uugguggcacacaccuguugacccagcuaggagacugaaauccuccuaucucaguccccucgcugagucuacagguaagugugucaucaa

SEQ ID NO: 2243789 - RNA, 68 nt, Homo sapiens
guggcuacaugguguauugauuauugcugucuuuuuggacagaacugggaaaugcacauaugcaucac

SEQ ID NO: 2243790 - RNA, 110 nt, Homo sapiens
cuggagaaacuggggcaguugagcaacaucugagaucaaggcaaaacaaaaugcuugguaaacuuccccucaugaaugaguucuuggcugguacuccuuauuuuuuccag

SEQ ID NO: 2243791 - RNA, 56 nt, Homo sapiens
gcauauauauguaacuaccuaugaaaaauguaucauagguaguuauacaaaugugu

SEQ ID NO: 2243792 - RNA, 63 nt, Homo sapiens
ucagaggcagaguacauuuauucucugaugaagaucagaaguauugguaugcucuguuguuga

SEQ ID NO: 2243793 - RNA, 85 nt, Homo sapiens
guucuuuucaugaugaaacuguuauguaucuugauugggugguggugauccuaugacucuaugcauguuucacaauucaaagaac

SEQ ID NO: 2243794 - RNA, 73 nt, Homo sapiens
ucuuaaaaauggcucuggauagaaugcaggguauguuaucaucauugugauuacuuccagugcuguaaugagg

SEQ ID NO: 2243795 - RNA, 57 nt, Homo sapiens
agaauugggaguguccugauaucccgauaucuugagaacagaagcauuccuaauuuu

SEQ ID NO: 2243796 - RNA, 79 nt, Homo sapiens
uacucuuuggaaguuaauacagauagaguagaaacaaggcaaccuagcccccuccuuuuucuguuuuagcuucugggua

SEQ ID NO: 2243797 - RNA, 57 nt, Homo sapiens
ugucaugugagggaacuuguuccauuguuaauuuaugcugcgaauuccuccauggca

SEQ ID NO: 2243798 - RNA, 70 nt, Homo sapiens
cuuuuccauggugcucaugagacaagcaggaguaggauuagucugccuuguucucugaguccuggcaaag

SEQ ID NO: 2243799 - RNA, 70 nt, Homo sapiens
agaaagaauacaagcaggaaaugguauauguaguagucuuauuuuucuuuccuaguuuguuuaaauuucu

SEQ ID NO: 2243800 - RNA, 124 nt, Homo sapiens
gccugacuagcuaccuacuguaacaaaaucuguaucaugucuucccagugauucuauauuuugguaauauagaaucaacuuguggagaaggcagcaugauguagugaacaaagcuucagcaggc

SEQ ID NO: 2243801 - RNA, 64 nt, Homo sapiens
caccauacauucucuauaagugcauguguguuuacauaaaugcacagaaaggauguggaaggug

SEQ ID NO: 2243802 - RNA, 88 nt, Homo sapiens
gcacaagucuuggacuucccagaaagacguugaccauguauugccuauugguaauguaauuuggagaaggcaugaaaaggcuugaugc

SEQ ID NO: 2243803 - RNA, 97 nt, Homo sapiens
uuuuguacauugauuuuguauccugaaacuuuacugaagucauuuaucaguuccaggaguccuuugguggagucuuuaggguuuucuauguauagaa

SEQ ID NO: 2243804 - RNA, 80 nt, Homo sapiens
uucuccucguggcugcagcggcuguggagaaaccagguguggccagugucuuagugcggcugcugcagccacaaggagaa

SEQ ID NO: 2243805 - RNA, 73 nt, Homo sapiens
uuaaagacagggucucgcuauguugcccaugcuggucuugaauuccuggggucaagugaugcuucugcuuuaa

SEQ ID NO: 2243806 - RNA, 77 nt, Homo sapiens
caggcacccaccaccaugccuggcuaauuuuuuggacgggguuucaccgaguuagccaggauggucuugaucuccug

SEQ ID NO: 2243807 - RNA, 61 nt, Homo sapiens
gguuaggaaguuuguucaggucacacagccauuuggugacaguaucuacagcuucuuaacc

SEQ ID NO: 2243808 - RNA, 129 nt, Homo sapiens
uggaaaugagcagagcacauuaauaucgaagaaucugugauuuuccaguggcccugaucaugauucuuuuguggucugguuagggguuggauaacagagaaccuuggguuuauucuacugcuaccucca

SEQ ID NO: 2243809 - RNA, 58 nt, Homo sapiens
uggaaguggcagaggaagugguauaggaaaauuaaaucacuuugacggccaacuucua

SEQ ID NO: 2243810 - RNA, 97 nt, Homo sapiens
ucguggggguacuuaggaacaguuuuagacuaaugcgaaaggaauucuauuuaggaaugaagcuuguuucuguaccuuuucuaauguucuuccacgg

SEQ ID NO: 2243811 - RNA, 60 nt, Homo sapiens
auagguccugugagauucaugcucaaagagguucuguuuugauguguuuccaggauuugu

SEQ ID NO: 2243812 - RNA, 81 nt, Homo sapiens
ugugcacucuuuggcaaggaggggcacuuucacugaugccccauuauaugaggugaaauauccccuucuuucuggaccaua

SEQ ID NO: 2243813 - RNA, 68 nt, Homo sapiens
cacuuuagcacaucuuucuauguaaggucaauauuuagguucacuuacaaaucaagagugcuuaagug

SEQ ID NO: 2243814 - RNA, 65 nt, Homo sapiens
ucagaaguuuucacugugacaacccaccucauucagacaccacgggauacuaguaaggcuucuga

SEQ ID NO: 2243815 - RNA, 129 nt, Homo sapiens
ugucgagagcagugccgggcacggaguuggcgcucuguaagugcuugcugaauaaaugacgggugugugugucauucauucagcaagcacugagugcuuacuguugugucaccgggaccgauguggagg

SEQ ID NO: 2243816 - RNA, 78 nt, Homo sapiens
ggauucgguuugccaguauuuuauugaggauuuucguauggauguucaucagggauauuggccugaaauuugccuucc

SEQ ID NO: 2243817 - RNA, 60 nt, Homo sapiens
gugagaugaggucucacucuguugcccaggcuggagugcuauugugagaccucagcucac

SEQ ID NO: 2243818 - RNA, 63 nt, Homo sapiens
auguuuauacauacuuguguaugugcauuuaauagaauguaaaccauauauguauguagaugu

SEQ ID NO: 2243819 - RNA, 63 nt, Homo sapiens
cuugcucuaguagcggggcugugaaagaggagacaguaauguuugguccuccuacagggcagg

SEQ ID NO: 2243820 - RNA, 64 nt, Homo sapiens
uuucccuuucugccuugaaucuuucaugccuccaggucaaaagagagagacagagacagggaaa

SEQ ID NO: 2243821 - RNA, 83 nt, Homo sapiens
gggaaccgggugucugagcauggggccggcaggaccgacagcaucggggcuugaaacccagugcucgggagcccgccccuccc

SEQ ID NO: 2243822 - RNA, 78 nt, Homo sapiens
uuuccacauuacaguguuuugguauuccacauuagaaaguuuucuuguuugugguuaaaacaauugauaaccugggag

SEQ ID NO: 2243823 - RNA, 58 nt, Homo sapiens
uuuuggcaaagaggaaugccacuuucuucacuuagaagggcaugacuuuuuuuuaaga

SEQ ID NO: 2243824 - RNA, 59 nt, Homo sapiens
uucauuguguuuaucauacaagagcaaagugagccaagcucaguggauagaacaaugaa

SEQ ID NO: 2243825 - RNA, 68 nt, Homo sapiens
gcaggcuucaucaaauuuagguauuuagacacugugucuacuucagacuggauugugaugggauuugc

SEQ ID NO: 2243826 - RNA, 122 nt, Homo sapiens
gagaauuuuuauaugcuuguuggcugcaugaaugucuuauuuugagaaaugucuguucauauccuuugcccauuuuuuaauauuagacuuuugucagauacguaguuugaaaauauauuuuc

SEQ ID NO: 2243827 - RNA, 130 nt, Homo sapiens
acuccuggccucaaguaauccaccugccuuggccuccgaaagugcugggauuggcugggcgugauggcucacgccugcaaucccaauacuuugggaggccgaggcggguggauugcuugaggcuaggagu

SEQ ID NO: 2243828 - RNA, 57 nt, Homo sapiens
gggcugggaggugagucuggggugaaggccccaaucacccccacaccuccuuaguuc

SEQ ID NO: 2243829 - RNA, 70 nt, Homo sapiens
ucacuucuuuugugauucuucaguugcuucaggccaucugaauguauugugcaggucacaggggauguga

SEQ ID NO: 2243830 - RNA, 73 nt, Homo sapiens
uuuagguacuuuggagagauucaaguauguaaagcaucaucuaugauguaaaugaauccaccagagaucuaag

SEQ ID NO: 2243831 - RNA, 69 nt, Homo sapiens
auggguagggauagagagcagauuuauguuuuaaccauauguuaaucuguucucuguauucuauaccau

SEQ ID NO: 2243832 - RNA, 77 nt, Homo sapiens
uaguuuacugagaaugaugauuuccaauuucauccaugucccuacaaaggaaaugaacucaucauuuuuuauggcug

SEQ ID NO: 2243833 - RNA, 106 nt, Homo sapiens
uuugcuaauguuaaggaugugugcuugugacacagccucaggagguacuaaugaccugugcccaagguggucaggacacaacuucguuucauacauuugaggcaga

SEQ ID NO: 2243834 - RNA, 60 nt, Homo sapiens
cauguguguugggcaggggcugucugugaauagcaaguuuagccccauguaaaccacaug

SEQ ID NO: 2243835 - RNA, 102 nt, Homo sapiens
cagggguuccuuucucuagagagacagugauauuuugggacacccuuucccugguguuugggaaugguuugucucccaugucuucagguacaggauccccug

SEQ ID NO: 2243836 - RNA, 68 nt, Homo sapiens
ugugaaugugcacauucugguaaauauuccuuugggcuaauagugacacaggugugugcacaggugca

SEQ ID NO: 2243837 - RNA, 62 nt, Homo sapiens
ccaugugauuagaaauguacacagcaguacugcugaccuaaaaaauuacauuuguuacaugg

SEQ ID NO: 2243838 - RNA, 55 nt, Homo sapiens
uuuaaugcacuaggugguguuccuuuucacccuaggagcacaggauaguauuaga

SEQ ID NO: 2243839 - RNA, 69 nt, Homo sapiens
uugggcucuggggagucacuaagugucauugcaaaguaguagcauuggggggcauccucgugugcccaa

SEQ ID NO: 2243840 - RNA, 56 nt, Homo sapiens
gggacuagaggugaaaagaagaccaguaacauaccaguuuuucagcuucugguucc

SEQ ID NO: 2243841 - RNA, 59 nt, Homo sapiens
gauaacuuccagacguugccauggcauuuguaaacugucauggcccugcugggaguguc

SEQ ID NO: 2243842 - RNA, 68 nt, Homo sapiens
uugcuugagccggggaggcagagguugcagugaccagagauugugccacugcacucuggccugggcaa

SEQ ID NO: 2243843 - RNA, 60 nt, Homo sapiens
uucccuucaaguuuuagauucuagggaaguuaaaaugaguaucaaagacuuagaggggga

SEQ ID NO: 2243844 - RNA, 101 nt, Homo sapiens
ugaggcaggagaauuguuugaaccuggaaggcggagguugcaguaagccaggauugugcuacugcacuccagccugggagacagagcaagauccugucuca

SEQ ID NO: 2243845 - RNA, 86 nt, Homo sapiens
gggagagggaggccaaaagccuaacuaacugguuaaaaaaacuuuacccuuuugccggcauguugggcuucuggguuuccuucccc

SEQ ID NO: 2243846 - RNA, 60 nt, Homo sapiens
ugagggcaaaguggugcugagggcccaucuagguguugauagcauacauuuugcaucuua

SEQ ID NO: 2243847 - RNA, 74 nt, Homo sapiens
agguguccuuuaaaaauauguuguuugcccucucuuggauaauuaguuaccuaacauguuuuuaagggaagcuu

SEQ ID NO: 2243848 - RNA, 81 nt, Homo sapiens
ggaugugugcuaagggagugucuaaccuguuaacaccuucuugaagauguuacagaaaguaagaugcuuuuaguucaauuc

SEQ ID NO: 2243849 - RNA, 73 nt, Homo sapiens
aggaaaucuuuguacacuguugguaggauuguaaauuaguacagccacuauagaaaacaguguggaguuuccu

SEQ ID NO: 2243850 - RNA, 86 nt, Homo sapiens
uuucgcuuccuaaagggguaaucuaaggaauuccagacuuaugccacgauuuagaaucccuugcauuaucccuuuaaaagguggga

SEQ ID NO: 2243851 - RNA, 104 nt, Homo sapiens
guugcaacucagcuucugccucuuuggucaauugcugcggggaaaucuaaugaagaaucuccuugcaggguuugauaaagauguuugagucgauaaguugcaau

SEQ ID NO: 2243852 - RNA, 75 nt, Homo sapiens
aucaugcacuuggcaggaugauucccaauuggggagauuucgccccucaggggacaccuggcaaugccuagagau

SEQ ID NO: 2243853 - RNA, 128 nt, Homo sapiens
cucaggugauccacccaccuuggccucccaaagugcugggauuacaggcgugagccaccgugccugacugguaguucacacuugcaaccccagcacuuugggagguggaggugggaggauaccuugag

SEQ ID NO: 2243854 - RNA, 129 nt, Homo sapiens
cauucaaaucacuuggagaguuccagaaagaaaaccucugucuuguccucacccuagagauucugauucagaugaucuagaguggggcaagggcacugguauuuaaucugaauccaagugauuuuaaug

SEQ ID NO: 2243855 - RNA, 64 nt, Homo sapiens
cuggcaaacagauggaccuggguuucugggacaguuccaauuucaaauguucucugguugucag

SEQ ID NO: 2243856 - RNA, 69 nt, Homo sapiens
aaaagugguguuguuucuaaauguugcuaacauuuacauuuguaacaaauuuggaauugauccauuuuu

SEQ ID NO: 2243857 - RNA, 59 nt, Homo sapiens
ggaaaguccuucuguaggcuccacauuucaccuggaugagccucgcugagggacucuuc

SEQ ID NO: 2243858 - RNA, 74 nt, Homo sapiens
ucuuuccccacagugguuuucaacuccaccugcauguuggaaucaucuagggagcuugaaaccaaggggaaggg

SEQ ID NO: 2243859 - RNA, 70 nt, Homo sapiens
gcuucaaaacuucaaagaacaggcugauuauuguuagggucuacugcagcuggugacuuuaaguugaagc

SEQ ID NO: 2243860 - RNA, 57 nt, Homo sapiens
gaagccagguuucagcauuuaggaugcagccaacagccaaauugcuuucuugguuuu

SEQ ID NO: 2243861 - RNA, 61 nt, Homo sapiens
uggagauguuuaaaauccacugagauagaaaaguauaccagaggguuugaaacauauucua

SEQ ID NO: 2243862 - RNA, 85 nt, Homo sapiens
gugcuaucuggagcuacugugauaggaacuguguguaaagaagacugcuuacagcacugugcauagugguucagacuauggacac

SEQ ID NO: 2243863 - RNA, 69 nt, Homo sapiens
cacccagucaucuuggguuuuuauggacgcuucaagacaucagcauuccuucucccaggguauagggug

SEQ ID NO: 2243864 - RNA, 83 nt, Homo sapiens
ugguacuuuuagaagugcuaagaaguggauuuugcaaugacucaugacacuguagcaccucuuuggccuuucguaaaguauca

SEQ ID NO: 2243865 - RNA, 55 nt, Homo sapiens
ugccaucauaaaaauaugugcuuauuauauguuagguacauaguauuuaguggca

SEQ ID NO: 2243866 - RNA, 57 nt, Homo sapiens
aacucuaauuggcuacaauggaagaggcuuaggcuuucacugagguuaaauaggguu

SEQ ID NO: 2243867 - RNA, 58 nt, Homo sapiens
cuaagcaccuuaguggggaaucuuuaaaagcagaagagccauucccgacugguuuuag

SEQ ID NO: 2243868 - RNA, 63 nt, Homo sapiens
cgcugcuuuuaagaacuguaacacucacugcaagggucuguggguucauucuugaagucagug

SEQ ID NO: 2243869 - RNA, 59 nt, Homo sapiens
guauagugaauacuuagguaacauagucauuuauuauucuuaucaaguaugcacuguac

SEQ ID NO: 2243870 - RNA, 58 nt, Homo sapiens
uuuggcuguaggaggggucuacgagagagacuaguggcaggacuccauuucagccaga

SEQ ID NO: 2243871 - RNA, 84 nt, Homo sapiens
uauuaggcuguugcaaaaauaauugccguuuuugccauugaaagugauggcaagaaccacaauuacuuuugcaccaaccuggua

SEQ ID NO: 2243872 - RNA, 57 nt, Homo sapiens
auauagacugcacguaagucacagguuauugguccuggaaaguacuugaguuuguau

SEQ ID NO: 2243873 - RNA, 88 nt, Homo sapiens
gugucuauacauguucaagggcauauauuaguauuuuaacuuauuauuggauacuaauauauguccuugaacauguacauauagacac

SEQ ID NO: 2243874 - RNA, 57 nt, Homo sapiens
gucccacuggucaauacacaaaaagccaaucagugaguugaguauugccagggaggc

SEQ ID NO: 2243875 - RNA, 71 nt, Homo sapiens
uuggacccucaguggauuagauaaugcacccccaccuugaggagggcaaucuacuucacugacucuaccaa

SEQ ID NO: 2243876 - RNA, 71 nt, Homo sapiens
cuucucuauuaugcaugucaaauuuguagguucuucucaagaacucaaugaagauauaguguauagggagg

SEQ ID NO: 2243877 - RNA, 130 nt, Homo sapiens
aaaauauggcggggcgugcucccagaccucagcaaauuguccuauugguuuuagucaaaaaguuaguuuauacugguaccaagcaccaauaggagauuugucaaaggucagggacgccuuuacucagaau

SEQ ID NO: 2243878 - RNA, 68 nt, Homo sapiens
ccuccguauuuagagugcucaaagaugaggacugcauccuugcauuuguagcucacucugagcugagg

SEQ ID NO: 2243879 - RNA, 105 nt, Homo sapiens
augcugacuugaacucugggcucccuggcagggcuuauugacuuugagcuucauugaagugccauguggaugggcccuuuguuguggaaccccucaggucaguau

SEQ ID NO: 2243880 - RNA, 60 nt, Homo sapiens
uugagacggagucucacucugucgcccaggcuggaguggaguagcgagaucucugcucag

SEQ ID NO: 2243881 - RNA, 82 nt, Homo sapiens
auuuuauauguaaauguagaggaaugaauuuggccagaauuauuccagcuaaguaucguccuuuuugauuuuacuaugaaau

SEQ ID NO: 2243882 - RNA, 67 nt, Homo sapiens
ugccuccaggaaugacacugauucugcaccuuuggcagugugcacaaucgugcauuccuugucugca

SEQ ID NO: 2243883 - RNA, 66 nt, Homo sapiens
aacuugcacuugauugagagcucauaguucaaugugcgauaaaugaaacucacucaggaccaaguu

SEQ ID NO: 2243884 - RNA, 59 nt, Homo sapiens
ucugaaacucaugauucuagccaagucugaaggcaaccaaaagagcacugaguuuuaga

SEQ ID NO: 2243885 - RNA, 57 nt, Homo sapiens
gacagagaucaugcaacugcucgccuuaggaggcgaaagucaacagguacucgaguc

SEQ ID NO: 2243886 - RNA, 114 nt, Homo sapiens
gagaggagagggaaggagacagaaggcaaauacaggagagacaggugccggcugugcacuugucacccucucuuggugucugucugucuauaugucggccuggcccucucucuc

SEQ ID NO: 2243887 - RNA, 65 nt, Homo sapiens
gccgccugguguuuugauggucggguaauaacaauaguaaucacacuauuaauaccagucccggc

SEQ ID NO: 2243888 - RNA, 77 nt, Homo sapiens
gcugccagagacagaguguuuuuuaagguacuguacugcucuuugcucuguacucagagaacauucccagucuuagc

SEQ ID NO: 2243889 - RNA, 56 nt, Homo sapiens
gcaggaugguuuuaauucuucaggucaguagaugugaugguuuggaagcuucuugc

SEQ ID NO: 2243890 - RNA, 81 nt, Homo sapiens
gugggguacaauguaauguuguguuacaaauauaccuugcggaauguuugagcaggcuaaucaauauauuuauuaccucac

SEQ ID NO: 2243891 - RNA, 71 nt, Homo sapiens
ugagguaugugaugucuuuuagcuaaacauucaucaaaacaaauuauuagaguaaaagcacgagugccuca

SEQ ID NO: 2243892 - RNA, 80 nt, Homo sapiens
aauugggaauuucccuguuguuucauaauuuuaguuaaauccucaaaacugaagcuaacaaguaggaagaguccucaauu

SEQ ID NO: 2243893 - RNA, 78 nt, Homo sapiens
agugagucacaggucauccuggaucaaggugcaggaaacagacucugccuccuugugcaggaauggccugugcacauu

SEQ ID NO: 2243894 - RNA, 104 nt, Homo sapiens
aggccugauuagucaaaaugauaucuuauccucuuugccaguauugguucaaaaauaagcaugugaccuaauucuggccaaagggauaagagguuugcuggcuu

SEQ ID NO: 2243895 - RNA, 63 nt, Homo sapiens
ccauguguccauguguucucaucauuuagcucccacuuaaaagugagaacaugugguauuugg

SEQ ID NO: 2243896 - RNA, 70 nt, Homo sapiens
auggacacuaaggaaggacugaaaggacaggagcuauaggcugcucucucuuccccuuuccuuguuccau

SEQ ID NO: 2243897 - RNA, 56 nt, Homo sapiens
gcccaccguggcuagaaguacuugagccgucaacaguaaagcuacucacugugggc

SEQ ID NO: 2243898 - RNA, 84 nt, Homo sapiens
uucuucugauuggacauuuuuccuuaaagagguaacaugauuuucagaucaaauugucauuuuaaggaugaugccucuggggaa

SEQ ID NO: 2243899 - RNA, 67 nt, Homo sapiens
ccauaaaaugcacaagugcuuuaaguugaaaucaguauguuguuuucuaaggcacugugcuuuuagg

SEQ ID NO: 2243900 - RNA, 86 nt, Homo sapiens
ucuagcuacuaugauaagacaucauuaaacagcaauaagaggaaaaacuuaucagcauucccaaaugaugugcuuguuuggcugga

SEQ ID NO: 2243901 - RNA, 95 nt, Homo sapiens
uuugagcauugugauucugcacucuuuuagcgaaguggugcugagugcucacugugguuugggaaagugcuggaaaggauccaagaugauucaga

SEQ ID NO: 2243902 - RNA, 107 nt, Homo sapiens
auucuggaaaauguugcuauauaaaacacauaauguaugaauagaaguauaugguaacugacagacuuuuguuauacagugugauaaagugaauagaacauuagaau

SEQ ID NO: 2243903 - RNA, 77 nt, Homo sapiens
ccaucugguggaguaugaguaaaauguaauaaaauauacacaccuguugacauguugcauuauauuucccggccaag

SEQ ID NO: 2243904 - RNA, 116 nt, Homo sapiens
aagacucauucaauacgagcucaaaugaaaacauugauagugaaccaagggguaauuagcuugaguuaauucugcugacauuauccugaugcuauuugaaggguugagagagucuu

SEQ ID NO: 2243905 - RNA, 59 nt, Homo sapiens
ggggauaagcacuguggggagcccgucauccaauguucaccacagccauuauugucccc

SEQ ID NO: 2243906 - RNA, 68 nt, Homo sapiens
cacaauccauucccagugguuagcucuggucuucaggagacuagaagcagcccucgggaauguucgug

SEQ ID NO: 2243907 - RNA, 130 nt, Homo sapiens
auguauaugcaccauagcauaugugguguauauguauaugcacuauagcauaugugguguauauguauaugcacuauagcauaugugguguauauguauaugcacuauagcauaugugguguauauguau

SEQ ID NO: 2243908 - RNA, 83 nt, Homo sapiens
cuguugcuuauuacauccauaggcucugcuucuacuaacguccuugaaccuuggagcagagccuauggagguauuaaggacag

SEQ ID NO: 2243909 - RNA, 67 nt, Homo sapiens
uuuucagcagugugaaaacaaacuaauacaguaaauugguacuaguagagugggacguugcugaaaa

SEQ ID NO: 2243910 - RNA, 82 nt, Homo sapiens
gucaucugagugguuaguggcuuuaaguacgauugaggaaaaguccugagaagaacaaagaccacuaaaauauaaaggugac

SEQ ID NO: 2243911 - RNA, 81 nt, Homo sapiens
ggauagaguugucgugaaaguuuaaugaaauugcaugcaccccagcauguaacaguaguuacuauucuuacagcuguauuu

SEQ ID NO: 2243912 - RNA, 55 nt, Homo sapiens
caaaggcuguuauaggccaggagugguggcucacgccuguaaucccagcacuuug

SEQ ID NO: 2243913 - RNA, 129 nt, Homo sapiens
uuuugguuaaauauugauaacuuugcacagcagaaugcagaauguucauuuuguggguagauagcagacaacuaacagguagagugaagcuuuuuauauucugugaaagugcagaagucauauaucaua

SEQ ID NO: 2243914 - RNA, 68 nt, Homo sapiens
guguguggguguguaucugugugugugugcaugcacaugcauaugcacgugcauacacacuugugugu

SEQ ID NO: 2243915 - RNA, 57 nt, Homo sapiens
gcaaaguuuugcagauuaaugggaaccuuacucauuaaacugucuuuggagcuuugc

SEQ ID NO: 2243916 - RNA, 103 nt, Homo sapiens
gucaccagcugcauuaucuccuaacaaagaagucagccuguccuuugaaguuuuaaagccaggaaaugacuucuccugucuagguauauaaguccuagguggc

SEQ ID NO: 2243917 - RNA, 66 nt, Homo sapiens
gccugccaacaugccuggcuguuuuguauuuuuaguagagacaggauuucaccauguuggccaggc

SEQ ID NO: 2243918 - RNA, 69 nt, Homo sapiens
uaauacucuucucauuuuacaguugagaaaaccaagcucaaaaaaugguaauaaugagugguaguauua

SEQ ID NO: 2243919 - RNA, 95 nt, Homo sapiens
gccagcaggaagaggggaaagucauggaggaguaugugagguuuaaugccacaucuguucacauuguacuggcuagaacucagccacacgcuggc

SEQ ID NO: 2243920 - RNA, 65 nt, Homo sapiens
guauugcacauggcaggugcucaauuauuacugaaugaauaaggaagccuggauuauugcaauau

SEQ ID NO: 2243921 - RNA, 68 nt, Homo sapiens
gaggugugagccaugguuagcuucucauuugcuaucaccaaguagacaugaaacaugguucauaccuu

SEQ ID NO: 2243922 - RNA, 82 nt, Homo sapiens
ggcauggguuguguuuuuuuaaaauaugggaguucaguuguuguagccccauuuguugaaaagacgauucuuucuccgugcc

SEQ ID NO: 2243923 - RNA, 80 nt, Homo sapiens
guucucuggaggcagggaccauguugaguuucuucacugucauauauccaugacauagcauggugccugcuacaugggau

SEQ ID NO: 2243924 - RNA, 60 nt, Homo sapiens
cuauagaagaaaaauugccuugcugagaaaacucauguucaagugcuauuucuuuugugg

SEQ ID NO: 2243925 - RNA, 81 nt, Homo sapiens
aaaaaagguuuuaaugcuuggucaagagcagaaaucugauuuuuagcucuuuguuuugacuaggaaauuagaacuuuuuuu

SEQ ID NO: 2243926 - RNA, 62 nt, Homo sapiens
ccuauuagacacaacaacauauaaguacagauuaagauguuaagaugugcuguguuguuagg

SEQ ID NO: 2243927 - RNA, 72 nt, Homo sapiens
agcugucaagagaacuuucuaucacuuccagauucgaucuuccaggcaguguggacuugaguuuuuacagcu

SEQ ID NO: 2243928 - RNA, 65 nt, Homo sapiens
gugaccugagagaguacuugauauaauuuugauuuuucuaaauuuauugagacuuucuuuauuau

SEQ ID NO: 2243929 - RNA, 80 nt, Homo sapiens
gggggcgagggauuggagagaaaggcaguuccugaugguccccuccccaggggcuggcuuuccucugguccuucccuccc

SEQ ID NO: 2243930 - RNA, 65 nt, Homo sapiens
auugauuuuuacauguggugugaagaagaggucaaacuucauucuuuuacaugugaauauucagu

SEQ ID NO: 2243931 - RNA, 87 nt, Homo sapiens
ccuuauuucaauguuugaagugaguagguacugugagcuauugacccugaaguagguauuacuguuauuccuaucaaacaaaugagg

SEQ ID NO: 2243932 - RNA, 60 nt, Homo sapiens
aaguucuauuuugaucuccaauugagaagaaacugaggcuuguggagauaagaagaacuu

SEQ ID NO: 2243933 - RNA, 71 nt, Homo sapiens
auuuucuuagucaaguuguauuucacuauggaaauaauugccaugugauugcauaaauugacaaggugaau

SEQ ID NO: 2243934 - RNA, 91 nt, Homo sapiens
uggcggugguugugguggugggguguguaugugcacgugugcucacaugugcaauguguacguagcccacgugugcacuaguuuccugcug

SEQ ID NO: 2243935 - RNA, 74 nt, Homo sapiens
ccuggcuacccagcuuguggggucacagcugucuuuuuuuccaaaaaggcacugugacuuuauaggccuccagg

SEQ ID NO: 2243936 - RNA, 80 nt, Homo sapiens
cagagcccuuacuguucacucuggagaauauugacuuccauaaggcaauaguccaccaggugaugaaggugguauuuuug

SEQ ID NO: 2243937 - RNA, 79 nt, Homo sapiens
uucugagguaagauguucauuuuucucuuucuauuuccaauuaauuaugaaacugggccuaacauacuuaucuacagaa

SEQ ID NO: 2243938 - RNA, 127 nt, Homo sapiens
aguucuaguugagugagugugaauaggagugauagaggaaugugggaggaauguguuuccaggucuggcccacaaauccuuccacaaaagauccucacugcucuuuucccuucugcugguagauauu

SEQ ID NO: 2243939 - RNA, 72 nt, Homo sapiens
uacauguauagauuccauaguggugaagacuggacuuuuaguguaaccaccaccugaauaauauacauugua

SEQ ID NO: 2243940 - RNA, 62 nt, Homo sapiens
gcaugcuguguaggcugcgauuucucaaguccaaacuggaucacaguuccucacgggcaugc

SEQ ID NO: 2243941 - RNA, 129 nt, Homo sapiens
auucauaguauggcuguuuucccacuggagggguuuuaccuucguauucuuucuuacguaagcaucaauaaggaagaaugggcaauagaacacuccuccuuaagauuccgcaugguucauacuaugggu

SEQ ID NO: 2243942 - RNA, 64 nt, Homo sapiens
auugugaauggugccucaguaaacauacgugugcaugugucuuuauagaagcaugauuuauaau

SEQ ID NO: 2243943 - RNA, 60 nt, Homo sapiens
augcaaacagcuaucuggcuggccuaaggcauucuucuccccuaguauagcugcuugcau

SEQ ID NO: 2243944 - RNA, 86 nt, Homo sapiens
cauugcagcuuuugaugcaucucauugaauugcugagcauacuucucagauguaacgguuucgcugggauucauaaagcuguagug

SEQ ID NO: 2243945 - RNA, 60 nt, Homo sapiens
ggauaaaagucaucacaacuggagugagaugguaucucauuguaguuuugacuuuuauuu

SEQ ID NO: 2243946 - RNA, 87 nt, Homo sapiens
ggagucucacucuguugccuaggcuggagugcaguggugcaaccuugguucacugcaaccuccaccucccagguucagugauucucc

SEQ ID NO: 2243947 - RNA, 62 nt, Homo sapiens
gucauuguauuuaacucgaaagggauuguagaaggcacaucucauuccuugaaaauaaugac

SEQ ID NO: 2243948 - RNA, 56 nt, Homo sapiens
guguguuuguguguguauaugaguguguccauauacauaugcagacacauacauac

SEQ ID NO: 2243949 - RNA, 58 nt, Homo sapiens
uugaggcuuuugaccucauguggccucuuuguucccugcagagguuaaugagcaucaa

SEQ ID NO: 2243950 - RNA, 67 nt, Homo sapiens
ugucuggaguccauagaagugucaccagagaaucccaauaaaagacacauuucuaaucuuccaggca

SEQ ID NO: 2243951 - RNA, 74 nt, Homo sapiens
aggcuuaauacuaggugauggguucauaggugcugcaaaccaccaugacacauguuuaccuauguaacaaaccu

SEQ ID NO: 2243952 - RNA, 129 nt, Homo sapiens
aaacugcaacuuuaagcaaaccaacuauagcagguccucaaaugacaucauuucauucaacaucauuuuuuuacagcguugaugagaaaaugugguuuggcuguauguuguuuugccuaaaguuaguuu

SEQ ID NO: 2243953 - RNA, 95 nt, Homo sapiens
cgcaguaacccaucaauucagugaaacaacuacuauugauuucuggggguuuuccaccccacugguuguuuaacugaauugauggguguucugug

SEQ ID NO: 2243954 - RNA, 104 nt, Homo sapiens
ucugucaacuaacacgcauguaagugagcuuggaagugacuucuuccccaagugagucuucagaugagguccuagccaacuuuuugauugcagcuugugacaga

SEQ ID NO: 2243955 - RNA, 66 nt, Homo sapiens
uuugugucccugcggcugaggagaaacggcuacuccgcgccaccucauccaccgacaggccacaaa

SEQ ID NO: 2243956 - RNA, 68 nt, Homo sapiens
gacaaugguacuagauaucuucagaguucacacuacacuuuuaccuugaaaaauauagucccauuguc

SEQ ID NO: 2243957 - RNA, 69 nt, Homo sapiens
ggugagaacagauggcuuuauuaugccgaauuguccaauucaucaacaugguaugccucuguauuuauu

SEQ ID NO: 2243958 - RNA, 70 nt, Homo sapiens
gcugucaguggagcuacaauucuggggucuagaggacaguggcccucuucucacagcuccacuaggcagu

SEQ ID NO: 2243959 - RNA, 67 nt, Homo sapiens
ggauauaaagaguuaguaaaauuuccucuauccauuugggguauaggaaacaaacucucuuaaaucu

SEQ ID NO: 2243960 - RNA, 76 nt, Homo sapiens
caguuuacugagaaugaugauuuccaauuucauccgugucccuacaaaggacaugaacucaucauuuuuauggcug

SEQ ID NO: 2243961 - RNA, 73 nt, Homo sapiens
agacuggcgggaaaguugggagaagaguacaaagaauucccgaagucucuucccccagauuuccugaaugucu

SEQ ID NO: 2243962 - RNA, 96 nt, Homo sapiens
ggagagaauuuuaaguugacaguaguagccccuuagauggaggauguuauuucauugucuuuugaggucaguuauugcugguuagaaauuuucucu

SEQ ID NO: 2243963 - RNA, 102 nt, Homo sapiens
gggguagagcugccugcaggggcagagagagggucagugacuugaugucuuuguccacugcuagccucugcacuuacuucauccuaaggccgguucuaccuc

SEQ ID NO: 2243964 - RNA, 75 nt, Homo sapiens
cucacaccuauaagccaaggcaugcauaauagagguaaaauucuguggacaguaucccuugccuuaugaugugag

SEQ ID NO: 2243965 - RNA, 60 nt, Homo sapiens
uugguccucccaugcucaagagacucucuuugccucagccuccugaguaacugggaccaa

SEQ ID NO: 2243966 - RNA, 82 nt, Homo sapiens
gguaucuuuacagcagugccccacucuacugguaccaauuuacuguauuaguccauuucugcgcugcugauaaagacauacc

SEQ ID NO: 2243967 - RNA, 56 nt, Homo sapiens
ugagacgaagucucguucuguaccaggcuagagugcaguggcacaauuucggcuca

SEQ ID NO: 2243968 - RNA, 98 nt, Homo sapiens
uggguagcccugggggcccgcaucacagcuccugugcuggcaaaccacaccauguuugccagugcaguagcugugaugcgggcccccagggcuaccca

SEQ ID NO: 2243969 - RNA, 61 nt, Homo sapiens
cauguuaaguggaaucauucaauauuuguccucuugcaacuagcuuauuucacuuagcaug

SEQ ID NO: 2243970 - RNA, 86 nt, Homo sapiens
uuggcagaggugugauguggagggcagauccagggcuuccaccacaggcuggauguuucugcccccuacuuacacauauauguuga

SEQ ID NO: 2243971 - RNA, 108 nt, Homo sapiens
cauaugggcuuuaauaauaauauaucaacaucgugucauuaguugugagaaauguaccauacuaauggcagauguuaauaacaggggaaauuggguaaggaguauaug

SEQ ID NO: 2243972 - RNA, 74 nt, Homo sapiens
uacuaagaucucugcaguuuuuuuggacgugugugcauguguuuguguauaugucugagacugggggaugggua

SEQ ID NO: 2243973 - RNA, 82 nt, Homo sapiens
cuggggcuuuuuggaggagguuagaucaugaggaaggaggcuucauaaauaugauuuaauguccuuauaaaagacaucccag

SEQ ID NO: 2243974 - RNA, 62 nt, Homo sapiens
uagguagguggaaaaguaauugcgguaauggcaaaaaccgcaauuacuuuugcaccaaccua

SEQ ID NO: 2243975 - RNA, 115 nt, Homo sapiens
gcugucuuuggaaaucugccauagauauucauggaauuaauuaaaauauacuggauuuaaauggagauagauagauugauugauugauguacaugauuuaagguauagagucagc

SEQ ID NO: 2243976 - RNA, 80 nt, Homo sapiens
gccgggcucugcagggaggaaggagaggugcugccggaggaggucgugagcuccucuucugcugcaggagugguccaggc

SEQ ID NO: 2243977 - RNA, 93 nt, Homo sapiens
cugggucaaaugguauuucuaguucuagaucccugaggaaucgccacacugacuuccacagugguugaacuaguaaaucauacauuuaaccag

SEQ ID NO: 2243978 - RNA, 85 nt, Homo sapiens
cuggacaaaagaucucugagaaauuucuuugugaugugcgcauucaucucacagaguugaacuuucuuuugauugagcaguccgg

SEQ ID NO: 2243979 - RNA, 109 nt, Homo sapiens
caauaaaaaauacucuaugauuauagccuaugguagacuuuuuaacuugguaaaauuauauuagaugguucaccaugaguagucgcauauucauacaguggaacuauug

SEQ ID NO: 2243980 - RNA, 59 nt, Homo sapiens
auuaaaauagaauuggaagcagaguuaggaaauuucuaaucugucaguuuuguguuaau

SEQ ID NO: 2243981 - RNA, 94 nt, Homo sapiens
aggaagagagagagacagagacagagaaauaaagcaagugguaagauauuaauuguccauuauucuguucuuagguguuccugauucucuucuu

SEQ ID NO: 2243982 - RNA, 127 nt, Homo sapiens
aaagaaaauaaggaagauuuaaacgaguugauauguacagcucucuaggauagguaaagaaaaccaaaucacagaaacguacauauugcaugaauuugucuauggauuuuuuauuuuuauuuuuuuu

SEQ ID NO: 2243983 - RNA, 85 nt, Homo sapiens
agagcaauauuuuuggugcaggagcugacucaucagauuagcagccucucaagauugaugauguuucugccuugccuauuccucu

SEQ ID NO: 2243984 - RNA, 68 nt, Homo sapiens
gugggaugcaaguaaaauugucuucagaaaaccucaacugaaauacacaguaaaaauuugcuucucau

SEQ ID NO: 2243985 - RNA, 74 nt, Homo sapiens
uauccaggaauuuauccauuucuucuagauuuucuaguuuauuuguguagagguauguauaguauucuuugaug

SEQ ID NO: 2243986 - RNA, 59 nt, Homo sapiens
guccucagugugcuuauuucggcuugcuccaugguuugcgguagcauagacugcaggac

SEQ ID NO: 2243987 - RNA, 70 nt, Homo sapiens
aagcugugcaugucugugacgacccuguguguaccugacaugggugagucuguacguguggucucggcuu

SEQ ID NO: 2243988 - RNA, 60 nt, Homo sapiens
ggagaguggguggcgugucgucuacaggaugacaucaccaccuccgucaucaccaccucc

SEQ ID NO: 2243989 - RNA, 59 nt, Homo sapiens
gugcacuguagaacccuuuguuguuauugccuguguaacaucaaguggaacuacagcac

SEQ ID NO: 2243990 - RNA, 59 nt, Homo sapiens
gagauggugugcuguuggaaguggcuucaauccaaggcuuccaacaacgacaccgucuc

SEQ ID NO: 2243991 - RNA, 59 nt, Homo sapiens
aaugcuggauggccugaggaaagauucaacugccucucuuuuugggcuuucauaguguu

SEQ ID NO: 2243992 - RNA, 90 nt, Homo sapiens
ucuugaguaccuguuuucaauaugugugauaaaaugggaaguacaugugaaguuuuccuccugcauucugaaauacaaguugccucaaga

SEQ ID NO: 2243993 - RNA, 58 nt, Homo sapiens
ucauuuuuuaacuggccuauuugguuuaugcagaagacauauggguguuggaaaauga

SEQ ID NO: 2243994 - RNA, 92 nt, Homo sapiens
cauggaugauauggaugugugugugcaugugcacaaauuauauguaugugugugaguguguaugugcauacacaagcuuaugugucucugug

SEQ ID NO: 2243995 - RNA, 74 nt, Homo sapiens
ggauauuuaggacuucaacugagcacuggaacagguucaugugauccagugcucaguuggaguccugaauaucu

SEQ ID NO: 2243996 - RNA, 66 nt, Homo sapiens
guauccugagggaggggagggaucaucagaguuggaagagugaugccuuuuuguccucaguuauau

SEQ ID NO: 2243997 - RNA, 84 nt, Homo sapiens
uauaauagguacuuguuuaugugaugugaugagaaguuccuaucuauaccagauagucuccaaguaacaucacguuaucuuaug

SEQ ID NO: 2243998 - RNA, 70 nt, Homo sapiens
uguagggagagggaguugcaccucagaccuaaaacuccaguggcuccuugggcaccccucccuccccaca

SEQ ID NO: 2243999 - RNA, 82 nt, Homo sapiens
ccuauaaaauguuuuaugcauuaauucuucauuccacacucugcuguauagaaugaaguuagauguugagaagauuuucagg

SEQ ID NO: 2244000 - RNA, 87 nt, Homo sapiens
gggagcuuguuaagaugcagaagcccagauguucugacucucuagguugggggaggauccagggcucugcauuuuaaacaagcaccc

SEQ ID NO: 2244001 - RNA, 65 nt, Homo sapiens
aggcauuuugcuagguucuagagagacaaaagaaaucagacaacucucauaaccuggaggagcuu

SEQ ID NO: 2244002 - RNA, 77 nt, Homo sapiens
ugaaggaucuaaaugguuacaaugcuuugcuuuugaaaacauugagugcaucguggccauuuuaaaagauugcuuca

SEQ ID NO: 2244003 - RNA, 65 nt, Homo sapiens
cugugcuugagagaugacacagguaccucacugaguguuacuguagugguucuccagguggacag

SEQ ID NO: 2244004 - RNA, 76 nt, Homo sapiens
aaccuuuccuaugaggcacuucauuagcuggcuccauuuucuggguguuaugaagaugccugguacauggaagguu

SEQ ID NO: 2244005 - RNA, 85 nt, Homo sapiens
uggugaugaugaaugaucuuuuacauguaaauuuacauucuguuuaguaauauuuuguugaggauuuuuacaucaauauucauca

SEQ ID NO: 2244006 - RNA, 79 nt, Homo sapiens
uccauuugguccaguguucagguccugaauaucuuuguuaauuuucugacuuaaggaucugucuaauacugucaguggg

SEQ ID NO: 2244007 - RNA, 64 nt, Homo sapiens
uucaguuugccaguauuuuauugaggauuucugcaucaauguucaucagagauauuggccugaa

SEQ ID NO: 2244008 - RNA, 78 nt, Homo sapiens
uccuauuucacagagagaacucaaaccauuggcuagaaacuucuucaaaaucuggucugauuuuucaucuguugggga

SEQ ID NO: 2244009 - RNA, 91 nt, Homo sapiens
ggagggacauucugaucuggaggugucuggggacguuaaacaaaagaacaugccaauuucuucagagccaccucaagucacugggcccucc

SEQ ID NO: 2244010 - RNA, 58 nt, Homo sapiens
cuuugcuucucaaauagugucaauuauuugccuuauugucauuuucugagaaguaagg

SEQ ID NO: 2244011 - RNA, 128 nt, Homo sapiens
cuuugauuuugacgagcaaaagcccuuguuagcauauaccaugcaguccaauaugcacauauuggaauauaugcauauuggacugcauggcauauccuaacaagggcuuuugccuguuaaaaccaaag

SEQ ID NO: 2244012 - RNA, 71 nt, Homo sapiens
ucugcccagagaucuuagcaaucuuacuaggaugccaugacuaugauuuggauugaagacuccggggcaga

SEQ ID NO: 2244013 - RNA, 129 nt, Homo sapiens
uucuuucuaaugggagccaccacauugcguuccuuuaauuacacagugucaugucguguuccccugugaaaugacacggaggaacaugaggugaccugggauaacugugaugaauugcaucccgaagag

SEQ ID NO: 2244014 - RNA, 55 nt, Homo sapiens
ggaagcauggcauuagcaccuacucggauuuuggugaggucaugaugcugcuucc

SEQ ID NO: 2244015 - RNA, 83 nt, Homo sapiens
cauaugugugccugugcaugacagcauacaaacgugcauaguguguauguguguaugcaugugugcaugagugugcacaugug

SEQ ID NO: 2244016 - RNA, 71 nt, Homo sapiens
aagagagcugguaugugugacugcauugagaguccagagaccugggugcugggaccaugcccuaucaucuu

SEQ ID NO: 2244017 - RNA, 66 nt, Homo sapiens
augggaaguauugccaucuuaacgauauuaaauccuccaauucauaagcaugguguaucuuuccau

SEQ ID NO: 2244018 - RNA, 99 nt, Homo sapiens
uauguauguguguacaugaguacauguaugguaugcauguguguacauguaugugaguacaugcauggcaugcauuguaccugugugugcacaugcaug

SEQ ID NO: 2244019 - RNA, 112 nt, Homo sapiens
ggaggcugaggcaggagaauugcuugaaccagggaguuggagguugcagugagccgagauugcgccauugcacuccagccuagcgacagagcgagacuccaucucucucucu

SEQ ID NO: 2244020 - RNA, 84 nt, Homo sapiens
ugccaguuugagaagcacagggccugugcuuucaguuuucucacauuugaauauuauguuguauggguuuuguuucuucuggua

SEQ ID NO: 2244021 - RNA, 62 nt, Homo sapiens
gggguuuacacauugaugagcuuuaaggaauaaaagauaagguccuuaaauguguaaccucc

SEQ ID NO: 2244022 - RNA, 58 nt, Homo sapiens
gaggagcucugcacgacuccacggaagggaacccagugaguuguagcuauaguuucuu

SEQ ID NO: 2244023 - RNA, 101 nt, Homo sapiens
ugaggcaggagagucguuugaacccaugagguggagguugcagugagccaagauugugccacugcacuccagcuugggugacagagugagacuccgucuca

SEQ ID NO: 2244024 - RNA, 81 nt, Homo sapiens
ucagaucaugaaaccuuugggcagagaguagaggguuuuccaaguauagaaucauauugucugccaagagggauaguuuga

SEQ ID NO: 2244025 - RNA, 76 nt, Homo sapiens
uugucugcaugucauaugauaguaacaagacaucccacauguaugaucaguugcaauuauguaacaauguagacaa

SEQ ID NO: 2244026 - RNA, 56 nt, Homo sapiens
uucucaggguacagucagaauguagauuaugucucaauucaaguaugccuugagaa

SEQ ID NO: 2244027 - RNA, 102 nt, Homo sapiens
uuuaauuugagggaucauagucauugucccucaaugucuaugaccccaauuaaaagggaucauagucauugagggacaaugacuaugaucccucaaauuaaa

SEQ ID NO: 2244028 - RNA, 90 nt, Homo sapiens
cuacacagguucccauuuggcuuaguugaccacagucuuguuuucuuccaagaagugagggaaacugguguuuaggaacacuguuaguag

SEQ ID NO: 2244029 - RNA, 72 nt, Homo sapiens
ucauuucccaugcuuauuccuuugcuauuauuuaagguuuggugaugaaguauaggaagggcuuggaaauga

SEQ ID NO: 2244030 - RNA, 59 nt, Homo sapiens
ugucuuuaagcaaacaguguuuguguaaccaccuuguagcaacauucagcuugaagaua

SEQ ID NO: 2244031 - RNA, 63 nt, Homo sapiens
aguuuacauguuguggguuguggccuuguuaaaaggcucacugcuucuacggcaaguugugcu

SEQ ID NO: 2244032 - RNA, 80 nt, Homo sapiens
cuggccgaauugagauaauuuaauaggggaaaguauaguuuuuuauacagcuaaaauauuaaguuaucaaauguugucag

SEQ ID NO: 2244033 - RNA, 112 nt, Homo sapiens
gcaacgcugugggcccauuugaagcuggagaccacacauuuguuguagcaccauuacaccugaguuugugguuuucuuguauugagcaguuuuagaagcagcagcagauugc

SEQ ID NO: 2244034 - RNA, 59 nt, Homo sapiens
uuauagcagugcaggaacagacuaacacagugaccaugucuuauugaucacugcuguaa

SEQ ID NO: 2244035 - RNA, 58 nt, Homo sapiens
cuaagcaauguuucagaaagaguuaggacaguuucguccuauugaaugcauuacuugg

SEQ ID NO: 2244036 - RNA, 62 nt, Homo sapiens
gaaggagcuuaucugccauuuccuacacaugugacauauggagaagcaugaucagcuacuuc

SEQ ID NO: 2244037 - RNA, 65 nt, Homo sapiens
cccaguguuacgugacagccuguagcuuuuuagucaucacugucaggcuuuugcauagcacuggg

SEQ ID NO: 2244038 - RNA, 80 nt, Homo sapiens
ggcaagaggcauggagguaauaaguuccaguguaugagaucauuaagagaaccauauucccuucauuuuauuucucugcc

SEQ ID NO: 2244039 - RNA, 98 nt, Homo sapiens
caucagggcaguaguggcuugcaagaugauuucaauugauagguggaagcacauuuuuuaaaacuguguaaucauuuugauauauuauuguuuugaug

SEQ ID NO: 2244040 - RNA, 60 nt, Homo sapiens
cagggucaguuuuuuuaaccauccauauuuguacugugguuagguaugagagcgaccuug

SEQ ID NO: 2244041 - RNA, 73 nt, Homo sapiens
ugccuggaaucuauggauaacaucggguucuaagucaugaguugauuuuuaucuacuagguuuacgccaggca

SEQ ID NO: 2244042 - RNA, 92 nt, Homo sapiens
guuugugaaaauguggguugcugagucccaucaccagaguuuuaauuuaguaggucugggauguggcucaauaauuugcauuucuaauaagc

SEQ ID NO: 2244043 - RNA, 65 nt, Homo sapiens
augauuaacaccauuuuucugcagccuucauacuuauguagaugguuauauggaugguugauuau

SEQ ID NO: 2244044 - RNA, 58 nt, Homo sapiens
uuggugaaaugaaagcugcuuggaucaggacagauuagaguggcuuuuguuucaccag

SEQ ID NO: 2244045 - RNA, 97 nt, Homo sapiens
cuggaaugugcuaucuaccaugagcgauuagauguacuauguacucaaggauauauaguguuuuuugguacgcuugugguugagaaguuucuuuugg

SEQ ID NO: 2244046 - RNA, 76 nt, Homo sapiens
guucuauggucuuuaguugaaacaugugguagugacugcgauacugcuauaagaggacagaugaagauuacagagc

SEQ ID NO: 2244047 - RNA, 64 nt, Homo sapiens
caugugcaugcuguucugccagaaagauggagccacaccaaacuuucugcagaaggcauacaug

SEQ ID NO: 2244048 - RNA, 74 nt, Homo sapiens
aggaaggguaauacaucaaaucauuauccguuacuaacuccuugauguuagugaaugggugugauuuguuuccu

SEQ ID NO: 2244049 - RNA, 67 nt, Homo sapiens
uuacuugcuugcaugucauaacugauggaaauaaaaauauuucuguuuacacauaugcaaaaagugg

SEQ ID NO: 2244050 - RNA, 80 nt, Homo sapiens
ccuuuuucuaagauacauacagucaacugauagaggcaagaccgucuuuaacagugucaaucuguaguagagaaagaagg

SEQ ID NO: 2244051 - RNA, 67 nt, Homo sapiens
uguuuaggguuuaaauuagacaucauacauuauguguaugauagguuuagguuuagacauaaaaaca

SEQ ID NO: 2244052 - RNA, 70 nt, Homo sapiens
gguauaauauugucucugugcuuugcaacaacauccuuaacauuguauguaaagacaggauaacaccacc

SEQ ID NO: 2244053 - RNA, 88 nt, Homo sapiens
ggagaauugcuugaaccugggaggcggagguugcggugagccgagaucgugccauugcacuccagccucggggacagagcaagacucc

SEQ ID NO: 2244054 - RNA, 61 nt, Homo sapiens
ugaucucagcucacugguugaaacgauucuucugccucagccucccaaguagcugggauua

SEQ ID NO: 2244055 - RNA, 100 nt, Homo sapiens
cagaaaaauaaggacaguuuauuugagcaacauagugagacuguccuauccuuaaaaggacagucucacuauuuugcucauuuuauuguuuugcacccug

SEQ ID NO: 2244056 - RNA, 56 nt, Homo sapiens
uugagauggaguuucaauauugucacucaggcuggagugcaauggcucuaucucgg

SEQ ID NO: 2244057 - RNA, 65 nt, Homo sapiens
ccauauggcuaugggaacugggaguguggggcuccaagcuccauggggaccccaggccaggaugg

SEQ ID NO: 2244058 - RNA, 62 nt, Homo sapiens
uuggccagugucggaggccaggagggcuggaaggaagaguucuggaagaggacauuggccag

SEQ ID NO: 2244059 - RNA, 100 nt, Homo sapiens
uuauuguaauuuuaaaccauuuucaguuucagaugcuuuagaaauagaccaguuguuuuugugguauauugcaacaacgggaagauuauauuaccaauaa

SEQ ID NO: 2244060 - RNA, 78 nt, Homo sapiens
gcagaugcucaguggguguaauuuucucucucuuccuauuugugagucgacaugaaaacugcuucucuggguuucugc

SEQ ID NO: 2244061 - RNA, 62 nt, Homo sapiens
guucccuaacuuuccaugagaaaucuaaggcacagaccucauucacaagggaaguagggggc

SEQ ID NO: 2244062 - RNA, 56 nt, Homo sapiens
guugguucuguuuaugugauggguuauguuuauugauuugcauaugucgaaccagc

SEQ ID NO: 2244063 - RNA, 76 nt, Homo sapiens
uugcuugaacgcaggagguugagguugcagucagccgugaucgugccacugcacuccagccuucgugacagagcga

SEQ ID NO: 2244064 - RNA, 63 nt, Homo sapiens
uuacccagaagucauucaggaacagguuguuuaauuuccauguuauuguauggcuuuggguga

SEQ ID NO: 2244065 - RNA, 58 nt, Homo sapiens
uuguauccugagacuuuucugaaguugcuuaucagcuuaaggagauuuuaggcugcga

SEQ ID NO: 2244066 - RNA, 77 nt, Homo sapiens
ugcgcguccgugugaagagaccaccaaacaggcuuugugugagcaacauggcuguuuauuucaccugggcgcaggcg

SEQ ID NO: 2244067 - RNA, 126 nt, Homo sapiens
uuaauuuucugccuuuuugaguuucuccaguuauccuggaagcauagcagcguguguguccuuggguaggacccacuugcugugcauuccacuuugcacauugagaaaccaggcccagagaauuga

SEQ ID NO: 2244068 - RNA, 86 nt, Homo sapiens
ggccuuauaguauaguuugaagucaggaagugugaugucuucauauuuguucauuuugcuuagucuugcuuuagcuaugugggguc

SEQ ID NO: 2244069 - RNA, 74 nt, Homo sapiens
gacaagcuggcuuccuguguccgaauggggaagacaguuucuguuccuacuguucaucaggaaccagucagguc

SEQ ID NO: 2244070 - RNA, 58 nt, Homo sapiens
uuggccuuuucaaugccucuuucccaaaccauuaauagagaggcacaguaaaugccaa

SEQ ID NO: 2244071 - RNA, 66 nt, Homo sapiens
auagaugacaguuaggaagcugguggagcuuuaaugcuugcuuugcuuuguugauggugagucugu

SEQ ID NO: 2244072 - RNA, 61 nt, Homo sapiens
guguucaaauucugacagagagcuggucucaaauuccagcagucacugaccaguugaauac

SEQ ID NO: 2244073 - RNA, 84 nt, Homo sapiens
ugggucaaaugguauuucuaguucuagauccuugaggaaucaccacacugucuuccacaaugguugaacuaguuuacucuccca

SEQ ID NO: 2244074 - RNA, 126 nt, Homo sapiens
guaaacaagcuguugucauacuugaguccuugaguauugaauuugagcugucucuuagugacaauaccaaguagauaguuggauauucaaaucuggggcuuaggcagaggccagggcuauguauau

SEQ ID NO: 2244075 - RNA, 57 nt, Homo sapiens
aggcuauugauauaauucagguaaaagaaaaugugaccucaauucugucaauggcuu

SEQ ID NO: 2244076 - RNA, 64 nt, Homo sapiens
acagagaaauaaccuugcugcugaaauguuuacauuagcugagauggcaagaguuguucugugu

SEQ ID NO: 2244077 - RNA, 63 nt, Homo sapiens
cccucuucuacauucuugagcugaccuagaauuaggguucccccuuuggcaaugagaacaggg

SEQ ID NO: 2244078 - RNA, 82 nt, Homo sapiens
gugacugaauggaguuugaacaauuuccugggguacaaugcauuaucucuucccgauuuuguggcaaauucuucuuaagcau

SEQ ID NO: 2244079 - RNA, 67 nt, Homo sapiens
cccgaguaccugagauuacaggugcuggccacaccuggcuaauuuuuguaguuuuaguagagauggg

SEQ ID NO: 2244080 - RNA, 95 nt, Homo sapiens
ugggcaauucaagagauggauuuuuuaggcagagcuagauugagggguuccagugugccccagcucugcuuuaauccauguugauuuaauucuca

SEQ ID NO: 2244081 - RNA, 87 nt, Homo sapiens
ccagaaauuaaaggcggauagauccuucucaaaaucaaacgcucucuuugguuuugcacuguuuuaucugacaauuuugaguuuugg

SEQ ID NO: 2244082 - RNA, 65 nt, Homo sapiens
ccuccccauacaccacacaaacugugcaugcaugugguguguacaugugcaggucuguggggggg

SEQ ID NO: 2244083 - RNA, 70 nt, Homo sapiens
uaguauggguuggggauuugauuggcauuagucuucacaagggguacaaguaagaaaauugcccaugcua

SEQ ID NO: 2244084 - RNA, 89 nt, Homo sapiens
ggagaauugcuugagcccaggaggugaagguugcagugagcugagauugugccauuguacuccagccugggcaagaagagcaaaacucc

SEQ ID NO: 2244085 - RNA, 69 nt, Homo sapiens
cacaaaauuagccgggugugguggaacuccugaggucaggaguuccagaccagacuggccaacauggug

SEQ ID NO: 2244086 - RNA, 104 nt, Homo sapiens
aagaauuuuaugguuuuagcucuuauguuuaugucuauaauccauuuuuauuacuaguuguuuuggugcaugaugugaauguaagaaaauccaacuucauucuu

SEQ ID NO: 2244087 - RNA, 67 nt, Homo sapiens
gguggacuuuuuggauuuugguggcaacucauaccacauugggaugugcuacuucaauccauuuacu

SEQ ID NO: 2244088 - RNA, 89 nt, Homo sapiens
gccuauucuagacauucauguaaauggaaugacaaacuauguggcuuuuugugccuggcuucuuucacuuagcaugauguuuuuaaggc

SEQ ID NO: 2244089 - RNA, 58 nt, Homo sapiens
uagcauccuucucuaaacaggaggucaugaguagcuuucugccagagggaggguguua

SEQ ID NO: 2244090 - RNA, 95 nt, Homo sapiens
gaccaugaggacauuguuggggacccucccugaaccaaggaagagacugugacucuuccuugguucagggaagguccugaaccaaaucgaggguc

SEQ ID NO: 2244091 - RNA, 72 nt, Homo sapiens
uugguugaguaugcuuuugacauuuuacacaaaaaaguuugcccagauaaaugucauggaguguuuccccaa

SEQ ID NO: 2244092 - RNA, 67 nt, Homo sapiens
uggaauugaacuagaaccugcaaauuucaaugggaacaaaagguuaguaggauugguuuaccaucca

SEQ ID NO: 2244093 - RNA, 73 nt, Homo sapiens
ggcaaaauguucuagcgugcccuuguguacacucuaaacguuacacauuggcaauucuggagcaaacuuuguu

SEQ ID NO: 2244094 - RNA, 83 nt, Homo sapiens
gaaaaguucaaguggauggagaaguacaguccuuacagaaaugacaggacuggcuguuuucuuuauuauuauuauuauuuuuu

SEQ ID NO: 2244095 - RNA, 68 nt, Homo sapiens
aguuguguugguuacucugugaucuagauucucaaguuaucuccuucaugguagcaccaacaauaacu

SEQ ID NO: 2244096 - RNA, 74 nt, Homo sapiens
gcugaaucacauucaucaguuuuuuauaugugauguuauauuucauucaucacacaggaguuugauguuucagc

SEQ ID NO: 2244097 - RNA, 62 nt, Homo sapiens
auuaagauaguaaacauuuucugcuuugaaggccagacagucucuguugcugcuguuuuaau

SEQ ID NO: 2244098 - RNA, 128 nt, Homo sapiens
gaguaaaguaggagaagaagaaaacugggauagaagguggaucuugaugcauuugcuugaucagaagcccaaauggcaccggcucuucccucuucccagaaaaccugacuuucaaacaccacuggcuu

SEQ ID NO: 2244099 - RNA, 113 nt, Homo sapiens
acagaggacauuaaaagccaugcuaagaaguuuggcauuuauucuaaggucaaagggaagccaauugaaauuuaguaugaagccauuuuaagcacggguguaguguuuuuugu

SEQ ID NO: 2244100 - RNA, 60 nt, Homo sapiens
guauauccguacaaggggauauauccauauccauauccaugucccuuuguauggacauac

SEQ ID NO: 2244101 - RNA, 93 nt, Homo sapiens
aaggagaaucacuugaaucuggcaggcagagguugcagugagccgagaucccaucauugcacuccagccuagucaacaagagcgaaacucuuu

SEQ ID NO: 2244102 - RNA, 86 nt, Homo sapiens
uuuuuccucuuguaucacuguucauguguagucaccauguguauuagguacucaugcaaugagucaggaggcauuuccaggaagaa

SEQ ID NO: 2244103 - RNA, 60 nt, Homo sapiens
auggacuuggaagccauuauucuaagugaaguaacucaggaauggaaaaccaaguaucau

SEQ ID NO: 2244104 - RNA, 82 nt, Homo sapiens
ugcauauuugggcauguaggcccccuucucaggacaguuggaugcucaccugggaagaagguuuacuugccaaacaauugca

SEQ ID NO: 2244105 - RNA, 85 nt, Homo sapiens
gcuggugagcgugcccagggcuucagcggaggcagagaaacuuccagguacuuucucagcccccugacagucaggcuuuacuagu

SEQ ID NO: 2244106 - RNA, 88 nt, Homo sapiens
cccaguacuuuagaaugugaccuuauuuggagauaggguuguugcagauguaauucauuaagaugaggucauacuagaauacgcuggg

SEQ ID NO: 2244107 - RNA, 55 nt, Homo sapiens
caucaggaaggggagugggccgacaacacagcuggcuagacguccuuuccugaug

SEQ ID NO: 2244108 - RNA, 69 nt, Homo sapiens
cuguuuauaaagccuguucacagaugucauuuuuuuaaaaacuacaucucuuugaggcaggcaagacag

SEQ ID NO: 2244109 - RNA, 73 nt, Homo sapiens
ccgagggaaaagugcaguauuugggcagaaguguaccacuccuccagguacagucacucacggcuucccuugg

SEQ ID NO: 2244110 - RNA, 65 nt, Homo sapiens
ucuuuaaacaaguaauaauguuguacuuucuucaucuauacaucuuguauugcuugguuuggaga

SEQ ID NO: 2244111 - RNA, 67 nt, Homo sapiens
uuaagaaauaaaugguaucggcauuuguguauaguucuuuguaugcaaaugcugcuauuucucuugg

SEQ ID NO: 2244112 - RNA, 94 nt, Homo sapiens
cauuucccacgcugcagagacggugcuaaguuuuucacguauauuuucuugucgaaucagagcaauguuaucagucucugccacgugggaaaug

SEQ ID NO: 2244113 - RNA, 71 nt, Homo sapiens
caggcaacauggcgaaacucugucucuacaaaaaaauaccaaagucagcccagugucguggcaugugccug

SEQ ID NO: 2244114 - RNA, 56 nt, Homo sapiens
acgggcauuugggcgauuccuaacaugugcuguaacaaauaaugccagaugucugu

SEQ ID NO: 2244115 - RNA, 55 nt, Homo sapiens
ggcacugugccagauccucuuggaguugcaaagcuuaagacaugguccacaugcc

SEQ ID NO: 2244116 - RNA, 64 nt, Homo sapiens
auugugaaugaugucgcaauaaacauacgugugcauguguuuuuauaacagcaugauuuauaau

SEQ ID NO: 2244117 - RNA, 78 nt, Homo sapiens
uguuagccuguuuuaaguggcgugugguaaacuugcccacagauguuaguauacccgucuacuuugaacaaaauaaua

SEQ ID NO: 2244118 - RNA, 60 nt, Homo sapiens
uauaaaucaugcugcuauaaagacacaugcacacguauguuuauugcggcaucauucaug

SEQ ID NO: 2244119 - RNA, 59 nt, Homo sapiens
ugagacggaguuucacucuuguugcccaggcuggagugcaauggugcaaucuccgcuca

SEQ ID NO: 2244120 - RNA, 56 nt, Homo sapiens
uuggacuucuggacuccagaaccgugagaggauauacuucugguguuuuaagccaa

SEQ ID NO: 2244121 - RNA, 58 nt, Homo sapiens
aggauauucuaccccuagucagaugccucuuauagcaucucugguugugaauugucuu

SEQ ID NO: 2244122 - RNA, 119 nt, Homo sapiens
uucuccucuuuguuuuucuuugaauuuuucuucacugcaguguauuggacaguucacauguguaguucgacguaugaauguccugacgcugcaguuagaaacuaucacagacuggaagg

SEQ ID NO: 2244123 - RNA, 59 nt, Homo sapiens
auccaaucauuaaugucacuguuuaagggaaaaccuuggaaggcuccuaaugaauggau

SEQ ID NO: 2244124 - RNA, 103 nt, Homo sapiens
ucugucuccuuugguccagagccuuugugggacagcuguaggaggaggcccuggguacugcaguaggcccagcgggaggcaucuggucaaggaagagaacaga

SEQ ID NO: 2244125 - RNA, 58 nt, Homo sapiens
ugagaugaaaucuugcucugucacccaaucuggagugcaguggcaugauuucagcuca

SEQ ID NO: 2244126 - RNA, 96 nt, Homo sapiens
aaugcaaguauagagaaauaacugucagguucuggaaaacuguuguucuuaccuuaacucuucuacuucuuuauaguguuuuagaaugcuuggauu

SEQ ID NO: 2244127 - RNA, 62 nt, Homo sapiens
ccauuugcuagccauguguacuuggguaaguucccacacccucugcauugucugggaaaugg

SEQ ID NO: 2244128 - RNA, 68 nt, Homo sapiens
aauauauggcuacuacgaauaaugcuccugugaacauuuccaugcaagucuuuguguagucauauguu

SEQ ID NO: 2244129 - RNA, 95 nt, Homo sapiens
uuaaggcauuauuacuacguggcacugauaauaucaguuaaggcccuuuaaauaauaucaagugauuuguccauguggcacguggaauaucuuag

SEQ ID NO: 2244130 - RNA, 57 nt, Homo sapiens
acaggugaggaucugagccucacaaggacuucccuaagaggcauugugcucaucugu

SEQ ID NO: 2244131 - RNA, 82 nt, Homo sapiens
gagaccugguuucuugaggcaagauacugauuucauuggcaucuacuagcaagucuaugucuuuuucaacaauuggaguuuu

SEQ ID NO: 2244132 - RNA, 58 nt, Homo sapiens
ugagcugagauuaagcugcugcaugauuucagcccccuucaaauuuaaucucugcuca

SEQ ID NO: 2244133 - RNA, 73 nt, Homo sapiens
ggaguaaggaaucaggucaucugaguuuaguucugucuccaccagugacuggccaggugacuaugcaagcucc

SEQ ID NO: 2244134 - RNA, 74 nt, Homo sapiens
uagccucacaaagugcuuaagauuacaggugugagccaccauaccuggccuauuauuacuauuuuuguaggcua

SEQ ID NO: 2244135 - RNA, 72 nt, Homo sapiens
aggaaugcuuuuacacuguugguggguguguaaauuaguucaacccauguggaagacaguguggcaauuccu

SEQ ID NO: 2244136 - RNA, 56 nt, Homo sapiens
uucucaguaugaucuucauaaagggcagcuguguccccgaggaggucaucugggaa

SEQ ID NO: 2244137 - RNA, 72 nt, Homo sapiens
gggcaucuagguugauuccaugucuuuucuauuaugaauagugcagugaugaaccuaggaguggaugugucu

SEQ ID NO: 2244138 - RNA, 79 nt, Homo sapiens
guuucagacacucuguaaggcacuaagcauaugucagugaaaagaauuacuacaucuuugcucuuauagagcuuggaau

SEQ ID NO: 2244139 - RNA, 86 nt, Homo sapiens
gggguccucaaugauuuuuaguguaaauggguucugagaucaaauaguuucagaaccucugauuuauacuuuaccguggugauccc

SEQ ID NO: 2244140 - RNA, 56 nt, Homo sapiens
uuauaggcaggugguguagaugggagcaaacugaugaaccauaaagaugccuguaa

SEQ ID NO: 2244141 - RNA, 75 nt, Homo sapiens
auucccagugcugugcaguguaugaguuucuaaaacaaccagaaugugcuucaaaacaccacagacauugugagu

SEQ ID NO: 2244142 - RNA, 120 nt, Homo sapiens
caaggcaggacauguuuuugcaacauagcauuaugcccauuuguuuucugaaaguucucuaauuguuucauggcuuuauuaaauagauggucauucuagaugacaggaacaguucccuug

SEQ ID NO: 2244143 - RNA, 95 nt, Homo sapiens
ucuguuuaaugcaggguggcaaaguaagagaauggguuacuuuccucagcgggugggaaacauaagacaucucuuauugcccaaggcaaugcaga

SEQ ID NO: 2244144 - RNA, 66 nt, Homo sapiens
gugucagaaucucagaugacaacgucaggugcaagcaccuaauguugucgucucagauucugacac

SEQ ID NO: 2244145 - RNA, 65 nt, Homo sapiens
uuuguauuuucaguagagacacgguuuugccacguuggccaggcuggucuugaacugaccucaag

SEQ ID NO: 2244146 - RNA, 66 nt, Homo sapiens
aguaagacccuccuucucaguaugguugaaauccaguaucauuauuacuugagacagggucuugcu

SEQ ID NO: 2244147 - RNA, 126 nt, Homo sapiens
gauuuuagauacuucaaccuuaaguugauauuauguaacugugguucagcagagauaagagcaggagauuuuuuugggaucauuaugcauaguguacauuggcuuuugguggggguacuuagaauu

SEQ ID NO: 2244148 - RNA, 60 nt, Homo sapiens
uggcaaaauauuuugguuucugcuguaaaguguaugcaguaaagccuaagauauuugcua

SEQ ID NO: 2244149 - RNA, 62 nt, Homo sapiens
aggguuccuaacuuucuauaguuaugaacuuuuuugguuaucuaaggaaagcuaugaacccu

SEQ ID NO: 2244150 - RNA, 130 nt, Homo sapiens
ggguugaugguggaguuuuaccuuuguucucuaacuacuucuaaguuuuggaagaaacaggaggacccauguuucuuccaaaacuuagagguagaauuggaaaacgggugaauguuuucuuccagaacuu

SEQ ID NO: 2244151 - RNA, 62 nt, Homo sapiens
gcgcuuccuuugcucaaaauuguguucuucuuaauagagccaguauuuauguaaggaagugu

SEQ ID NO: 2244152 - RNA, 58 nt, Homo sapiens
gcccuagaacucgaggcuauagugaacuaugauugcacuauugcacuccagucugggc

SEQ ID NO: 2244153 - RNA, 85 nt, Homo sapiens
aguuacuuucuggagcucauuguugcuaaagagauacguuauaaaaaacucaggucuuuuaaguugacaauuucaaaaagccacu

SEQ ID NO: 2244154 - RNA, 105 nt, Homo sapiens
ucaaggugaagaguggggaguugggagcagggauggaguacccaggauaaaucugagaaacagguuacugcaucgaaaugcuuuuauccuuccucaucccuaugg

SEQ ID NO: 2244155 - RNA, 55 nt, Homo sapiens
cuaguucuagaucccugaggaaucaccacacugacuuccacagugguugaacuag

SEQ ID NO: 2244156 - RNA, 93 nt, Homo sapiens
cgcccgggcuccagcuuuggcucuggcugggcuccagcuccuucagcugcaccagcuccaccagggccuugguugugaagauggagacccgcg

SEQ ID NO: 2244157 - RNA, 64 nt, Homo sapiens
aaaguaaauagcagaacagugucucacugcaugugugugaugcacaguugcugguagauacuuu

SEQ ID NO: 2244158 - RNA, 103 nt, Homo sapiens
cacagucucagguaguaucuuuauagcagugugaaaacagacugauacagagaauugguaucaggaguuugggguacugcuauaaagauaaacugaaaaugug

SEQ ID NO: 2244159 - RNA, 68 nt, Homo sapiens
guggaaugauaucucauuguggcuuugccuugcauuucacuaauggcucaagaugaauaucuuuucac

SEQ ID NO: 2244160 - RNA, 67 nt, Homo sapiens
gggcauugugggcagagggcagggcugugccucaguuuuccaagccucuuccugugccacagugccu

SEQ ID NO: 2244161 - RNA, 87 nt, Homo sapiens
gacagaguucuggcaccugauucccuugcucugagaagaggguggggccuucuuugcuuggaagcgggggacaggaagcaacagguc

SEQ ID NO: 2244162 - RNA, 58 nt, Homo sapiens
ccauaguacuugcauaguacuauguggaguccacauaguacuccaccaguacaugugg

SEQ ID NO: 2244163 - RNA, 80 nt, Homo sapiens
ccagagagucucuccagguacgccacacagucuuugagcugugucagagcuggauuguuuaccuggggcuggcuguuugg

SEQ ID NO: 2244164 - RNA, 76 nt, Homo sapiens
gggcaggcaauggaggcuaguaaaaagguagaauuuuucuugggguucugcugauucucugagccucaguuugccc

SEQ ID NO: 2244165 - RNA, 87 nt, Homo sapiens
augaaagguauguacuuuauccagggagagccuuagcauacaacagaacuccuuaagguguagucucuggauaagcagugccaucau

SEQ ID NO: 2244166 - RNA, 91 nt, Homo sapiens
uuuuggguaucuucuuagcagcaccccacucuacugguaccaauuuacuguauuagucuguuuucaugugcugaugaagauauacccgaga

SEQ ID NO: 2244167 - RNA, 130 nt, Homo sapiens
uuuuuuuucuauuaugaauaaagcuguuaugagccuuuuuguagauauucuuucaguuuuuuugagcaagaaaaaauagauaguauaauugcuuggccauaagguagguuuauuuucaauguauaaaaaa

SEQ ID NO: 2244168 - RNA, 55 nt, Homo sapiens
gacgccuuccugucagcuauaagcacauaaaguauguggcuagaggccaggcguu

SEQ ID NO: 2244169 - RNA, 76 nt, Homo sapiens
agugacuucccugaaucucagguucuguauuagucuguucucgcauugcuauaugccugagauuagguaauuuauu

SEQ ID NO: 2244170 - RNA, 79 nt, Homo sapiens
cacagcccauccuugcaauacguucuccuuugccugaagcaugcuggaaagacuauuguaaaggauggcaucaguugug

SEQ ID NO: 2244171 - RNA, 81 nt, Homo sapiens
caaaaaaaguuaccuaggaaguauguguuauugcugcuguauccaaguauucaagcuagcaucuauuuucagguauuuuug

SEQ ID NO: 2244172 - RNA, 56 nt, Homo sapiens
agcacacacaguugucuucaauaaacauuccacguauauaaaggcacuguguuguu

SEQ ID NO: 2244173 - RNA, 66 nt, Homo sapiens
uauauuuuucuaauugcauuggcuaagauuucgaaugaaauguucaguagucauugggaaagugug

SEQ ID NO: 2244174 - RNA, 91 nt, Homo sapiens
gcugcuagauucaguuugcuaguauuuuguugagaauuucugcaucuaaguucaucagggauacuggccuguaauguuuguuucuugcagu

SEQ ID NO: 2244175 - RNA, 64 nt, Homo sapiens
uggugagaaaugagaugcuuuuuuucaaagacugagaaaaacccagagacgucuauucucacua

SEQ ID NO: 2244176 - RNA, 56 nt, Homo sapiens
gggcgagaaucggcugcucagccccauagcagcuguggcagcccccaucucugucc

SEQ ID NO: 2244177 - RNA, 62 nt, Homo sapiens
guaaucucagcuacuugggagguugaggcaggagaaucuagaacccaggaggcggagguugc

SEQ ID NO: 2244178 - RNA, 105 nt, Homo sapiens
gaaaauugcagcuuuggguuaggucacuggaguugggucaagauucucuuugagagcaauggaguaugaaacccacuccaauuuggucagacccagguaauuuuu

SEQ ID NO: 2244179 - RNA, 70 nt, Homo sapiens
uuucccagaagcagagccugaggcagggauucagaugcucaugaacuguuugaggguuugcuuucagaag

SEQ ID NO: 2244180 - RNA, 85 nt, Homo sapiens
uaagaucuacucaaguuugaagugccauaugcgauacaguauucuagcuguaaucaccauguguacauuagaccucuagaacuua

SEQ ID NO: 2244181 - RNA, 105 nt, Homo sapiens
uuugcagcugagaaucuggaauucguggaaguuaagugacuuucugaguguggauuugaacuuugaauuauuugauuccagagcccagguucucagaagugcaaa

SEQ ID NO: 2244182 - RNA, 78 nt, Homo sapiens
gauuauuuuuaagggagacuuuacaagcauuaacaacuuguuugacuguuuuuguaaaguucucucccgaaaacaauc

SEQ ID NO: 2244183 - RNA, 66 nt, Homo sapiens
ucaucaguucuacauccuuauugcacugguuaggaccuccaguacaauguugaguagaagugauga

SEQ ID NO: 2244184 - RNA, 130 nt, Homo sapiens
ugcuguguccacuaaggguuaaauggauuaagggcagugcaauaugugcuuuguuaaacagaugcuagaagguagcauacucguuaagagucaucaccacucccuaaucucaaguacccagggacacaaa

SEQ ID NO: 2244185 - RNA, 126 nt, Homo sapiens
augaggggacgauaccgcugguugacuuugacacucaggauaauagucgggagguguuggcuucuuagcaccagaaucugaguuauucugaauaugaucaacuguuaaauugccauguuuucucgu

SEQ ID NO: 2244186 - RNA, 70 nt, Homo sapiens
ucuuuaagcagugcaagaauggaauaauaccauaaauugguggcuguagaguggguuacugcuauaaaga

SEQ ID NO: 2244187 - RNA, 59 nt, Homo sapiens
cauaagugaagucauuguauauugcagaccaacucuaguaggacaggauuucaguuaug

SEQ ID NO: 2244188 - RNA, 63 nt, Homo sapiens
uuaauagugacucauuuuccacacuucagccuucagcaguagugaaacaugagucacuguuaa

SEQ ID NO: 2244189 - RNA, 60 nt, Homo sapiens
accuacauguuccacauaguuguagcuguaucuggguaucacugugcacauaugauaggu

SEQ ID NO: 2244190 - RNA, 64 nt, Homo sapiens
uaagucuuuuuggaguuuauaaguguaagccacgguaccuuacucuuaugccuaugaggacuua

SEQ ID NO: 2244191 - RNA, 63 nt, Homo sapiens
caguuaaucuguagauucagcacaagcucaaucaaaagugagcagcuuuaucuguagaaauug

SEQ ID NO: 2244192 - RNA, 55 nt, Homo sapiens
ccuaugugugucuuugcauguaaguugagucucuugaaugcagcacacugauggg

SEQ ID NO: 2244193 - RNA, 63 nt, Homo sapiens
uuuuuuaguuagcugggcaugauggcucauacccacagccugcagucccagcuacuuaggagg

SEQ ID NO: 2244194 - RNA, 105 nt, Homo sapiens
cuuguagcuaaaaagagaaacuuaagugaugaaacuauaaaggaaugcuggaaaguuacuaucauagcagucaagauagucauuaucguuuuagggcaguacaag

SEQ ID NO: 2244195 - RNA, 83 nt, Homo sapiens
aaagaagaguaagagagcaucaauggcaugugggaaucuaaccacuugauauucccaugucauugaaguucuuacucuuuuuu

SEQ ID NO: 2244196 - RNA, 57 nt, Homo sapiens
gccuagagguugaggcugcagcgagccaugauugugcuuuugcacuccagccugggu

SEQ ID NO: 2244197 - RNA, 86 nt, Homo sapiens
uccaagucuuugcuauugugaguagugcugcaguaaacacauguguacaugugucuuuagagcagcaugauuuauauuccuuuggg

SEQ ID NO: 2244198 - RNA, 80 nt, Homo sapiens
aggugggggccaggggccagggugcagggacagggagcgccuugcccaugucauggugcucugggcccuggccugugcuu

SEQ ID NO: 2244199 - RNA, 82 nt, Homo sapiens
ccucaaaugauucacccaccuuugccucccaaacugcugggauuacaagcgugggcugauauuaugguuuaagacuuugggg

SEQ ID NO: 2244200 - RNA, 78 nt, Homo sapiens
ugggaaaaaggugcagcugcuuuggaaaauauuuugguaguuccucaaaauguucaacacagaguuacauaugaccca

SEQ ID NO: 2244201 - RNA, 77 nt, Homo sapiens
uuagauuauugagcauccacugucuuccuucacucuuuucucuacuaggaagauaaagugggagcucacuaauuuaa

SEQ ID NO: 2244202 - RNA, 65 nt, Homo sapiens
cugagguaacaaacuaugaguuacugucucugcuacuaaacuguugcuuauaauguuaccuguag

SEQ ID NO: 2244203 - RNA, 96 nt, Homo sapiens
gaacauguaaacuugcaagaaauauuuggugaaugaaugcauguuaaucugaauuuaguauugcagucuucauuaccagaaagcauuuacauguuu

SEQ ID NO: 2244204 - RNA, 59 nt, Homo sapiens
uccuacugucuucggggcacugggcuaaaaaucaaagucagucccucaaggcacuagga

SEQ ID NO: 2244205 - RNA, 91 nt, Homo sapiens
uucucagagcugccagaaacaucaucugaggguuugggcaucagcucugccuggcugguguucaggcccucagucacuuuggaagugagaa

SEQ ID NO: 2244206 - RNA, 93 nt, Homo sapiens
cuccagugccagcagggugcacggcuggguaagggaaaacaggcuguaccucugcuugugccccuucucagucgggcauuuuugugcagggag

SEQ ID NO: 2244207 - RNA, 59 nt, Homo sapiens
guaugaugcugagguuuggagugcaaacaaucuugucacacagauaguaagcauaguac

SEQ ID NO: 2244208 - RNA, 91 nt, Homo sapiens
cacaaauauuugcuccuguguuauaauugccuacaguauucaacagaguaacauacuguauaggauuguagccuaggagcaauaggcugug

SEQ ID NO: 2244209 - RNA, 66 nt, Homo sapiens
uguuuauuggaugacuagaaaugucaacuuucauuagcaaagugaauguuugguccuuuauaaaca

SEQ ID NO: 2244210 - RNA, 72 nt, Homo sapiens
agaucucaauagguucuccacagguucuccauagguuguccauagaaccuccacaggaccuccauaggaucu

SEQ ID NO: 2244211 - RNA, 87 nt, Homo sapiens
uucuuuucugugccuggcaauggucccugcacuuuacaaaacaaaguuaugagguagguacaauugccaccacauuacagaugagaa

SEQ ID NO: 2244212 - RNA, 55 nt, Homo sapiens
agcuguggcuuugacauguuaagauauuucauaacacagucaaauccacuuggcu

SEQ ID NO: 2244213 - RNA, 85 nt, Homo sapiens
uggauuguuuugagacacaggccuggggugcccuccaugggcucauagcccagaguugccucagguuucugcucccugcguucca

SEQ ID NO: 2244214 - RNA, 57 nt, Homo sapiens
guuugccuuuuagauaggaaugcugaaaauaaugagacacuucugucuggaggaaac

SEQ ID NO: 2244215 - RNA, 114 nt, Homo sapiens
auagaucuuguuggacugagugggauauauugauaucaucugcagucucuuguuauuauaguauagugacuacaugugaugucaguauaucucacucaacccaacuagaucuau

SEQ ID NO: 2244216 - RNA, 59 nt, Homo sapiens
ucccuuuggagguguccagcacugagaaagaugugaaauuggcuacugcuucagaggga

SEQ ID NO: 2244217 - RNA, 57 nt, Homo sapiens
uuugauguugagacuauaaagcuacaguaaucagcacagugugguauuggcaucaaa

SEQ ID NO: 2244218 - RNA, 57 nt, Homo sapiens
gaaggcaugcugcauggccagacagcugugguccaagugacaugcaaggcugccuuu

SEQ ID NO: 2244219 - RNA, 61 nt, Homo sapiens
gucaggcagugggagacaaaacugagaggccagacuuucagcuuguccucauucccuaggc

SEQ ID NO: 2244220 - RNA, 65 nt, Homo sapiens
acgucucuucauuuaugcaucaaugucacuuaucauugugccugguacauggagaaaauggaugu

SEQ ID NO: 2244221 - RNA, 75 nt, Homo sapiens
gauacagacuuugcuucauuuugggugugcagauacagaguuugcauugacacaugaagcucagguugucuuguc

SEQ ID NO: 2244222 - RNA, 88 nt, Homo sapiens
uggaguuguguaccuguagcucuucuaggcugggguugcauguuauugucacuacuagucugagaucucacaggcagccucagcucca

SEQ ID NO: 2244223 - RNA, 64 nt, Homo sapiens
uucaguuugccaauauuuuauugaggauuuucacaucgauauucaucagaauuauuggccugaa

SEQ ID NO: 2244224 - RNA, 69 nt, Homo sapiens
ggaaggccuugccgaaggaugccacccaaccagcaucuaacggacauggcauuuuuggcaaugccuucu

SEQ ID NO: 2244225 - RNA, 71 nt, Homo sapiens
cucaccggaggguuugaacuaacugcucuggauaacuggccaggugguguuggguuccagccccagguggg

SEQ ID NO: 2244226 - RNA, 82 nt, Homo sapiens
guucccuggaaaguggguuguuguaaagccaggacacuccuuguguuuuaucucuuugcacaucucugcuuucccuuugaac

SEQ ID NO: 2244227 - RNA, 70 nt, Homo sapiens
gaugcuuuauuguuaggucauguaaaaauaagccuuuguuguacaguuaaaugcccuaaaauggagcauc

SEQ ID NO: 2244228 - RNA, 79 nt, Homo sapiens
ugaacuguaucuuaaaggcuucggaucagaagguaaaacauuuuacuuuaauauaugugaaguucugagacucaacuca

SEQ ID NO: 2244229 - RNA, 85 nt, Homo sapiens
auuguuuuauuagguuagugcaaaaguaauuguagucuaauggcaaaaacagaauuacuuuugcaccaaccuaauauaaagcagu

SEQ ID NO: 2244230 - RNA, 88 nt, Homo sapiens
acccccuaccagaugucaugcacguuuauagaagcugcuguaaaaagcuaaaagugacaugaagugcaugauaguugguucaaugggu

SEQ ID NO: 2244231 - RNA, 129 nt, Homo sapiens
uaaaacccucacauauacacacaaaccccaccucucccaguguuuauuuugagccaauuuccaaagcuaauggguuuagaggaagcacuugaagauguggaguuugugugugccuguuuggggguuuug

SEQ ID NO: 2244232 - RNA, 80 nt, Homo sapiens
cacagucaacacuaggcaaaugccagcaaucacacuucaccacagggucauugaaaccuggcauuugggugcaugcugug

SEQ ID NO: 2244233 - RNA, 58 nt, Homo sapiens
acccaggaggcagagguugcagugagcagagauugugccacugcacuccuccuugggu

SEQ ID NO: 2244234 - RNA, 70 nt, Homo sapiens
ugucacacgggguauguuccuuuggauauuauucauaauguccuagagggaugucaccccuuaugucaca

SEQ ID NO: 2244235 - RNA, 87 nt, Homo sapiens
gaguuucccucuuguugccuaggcuggagugcaguggugugaucucagcucacugcaaccuccaccucccagguucaagcgauucuc

SEQ ID NO: 2244236 - RNA, 91 nt, Homo sapiens
ggcuugcccaggaauugcaacuguugagguauagaacaccuuucaaguuuauuuagaaacccaaagugcuuuauaccacaguggugaagcc

SEQ ID NO: 2244237 - RNA, 67 nt, Homo sapiens
agagccacuguccaaauuagauauuagaauucaagcuuuuaaacauuaaugcuuggggaguaguucu

SEQ ID NO: 2244238 - RNA, 66 nt, Homo sapiens
ggaaaacgcauccucacaggucugaagacagcacaccugaguggaucuucugggauaguguuagcu

SEQ ID NO: 2244239 - RNA, 67 nt, Homo sapiens
guagcucuaccacaguuccacucagagcagaagaggguacuucacaugauggaacugcuggagccac

SEQ ID NO: 2244240 - RNA, 87 nt, Homo sapiens
aaaggccuggguaggcccucauuggacaggucagccaaacauuugcaucagucacauuugucugaugagggccagccccaaaccuuu

SEQ ID NO: 2244241 - RNA, 59 nt, Homo sapiens
uuauugaugugcuuuugucuugcuuugguaucagggcaauacugaccucacguuaauag

SEQ ID NO: 2244242 - RNA, 55 nt, Homo sapiens
uauucacagcuuuaaaaggcgugacuccaaggguuaaugccuuagugguagaaug

SEQ ID NO: 2244243 - RNA, 90 nt, Homo sapiens
uuaauacaauuagcuuuagggaggacaguuacaacaggaagcaaauuccuugcagcauccgguccucucuuagccauguuaguugauuaa

SEQ ID NO: 2244244 - RNA, 67 nt, Homo sapiens
uccuuagcacugucuacucuggauuucuaauaaagagaagggaaaucgagggugaacugugcuagga

SEQ ID NO: 2244245 - RNA, 124 nt, Homo sapiens
uauauauauauauacacacacauauuuauucaggaccuacuaugugccaggcauauaucaaucaauacauuauuauugcuggcacauaguagguccugaauaaauauguguauauauauauaua

SEQ ID NO: 2244246 - RNA, 112 nt, Homo sapiens
cagaucaucaggcauuagauucucaacaggagcacaaaacuuagaucccucgugugugcaguucacaauaggguuugugcuccugugagaaucuaaugccgccgcugaucug

SEQ ID NO: 2244247 - RNA, 87 nt, Homo sapiens
gggcauguccuggaccaugaagaaaggcaagacagacucauagccuaucugcuuucucuuuuugcuuuuccucggucccaccagccu

SEQ ID NO: 2244248 - RNA, 109 nt, Homo sapiens
ggggacccgcggucauuuggguuuuuggcucugcgucucgcggacgguugcauuuccugcccccucccggcggccgcgugggccccacccgguggagcguggggguccc

SEQ ID NO: 2244249 - RNA, 61 nt, Homo sapiens
augaaaucauguaguuauugcaagauugcaauuugucuuugcauauauuucaugguuuugu

SEQ ID NO: 2244250 - RNA, 59 nt, Homo sapiens
uuggguuggcuguuucccccaagugaagaucauugacucucuaaagcuggccaacucaa

SEQ ID NO: 2244251 - RNA, 94 nt, Homo sapiens
cuuaaauaauaccugaguauuaguauaguagcauaccuaaguauacuauauaguaguauacaguaguaguagcauaccuaagguauuauuugag

SEQ ID NO: 2244252 - RNA, 99 nt, Homo sapiens
gaggcaggagaaucauuugaacccgggcggcagaaguugcaguaagccaaaauugcaccauugcacuccagccugggugacaaagugagacuccaucuc

SEQ ID NO: 2244253 - RNA, 55 nt, Homo sapiens
aauuguacucccaucauuccuaugcguugugggggggauacggugggagauaauu

SEQ ID NO: 2244254 - RNA, 61 nt, Homo sapiens
uggcaguguuauuauauuuuuggcacuguuuacaaucaaggguugaguaauaacaaugcca

SEQ ID NO: 2244255 - RNA, 55 nt, Homo sapiens
ugggggaagaaagagauguucuggcaugucccugugcagaguaucauuuccccca

SEQ ID NO: 2244256 - RNA, 87 nt, Homo sapiens
uguccuuaucuaugguaugucuuucuuccuguaggauagcauugaagcugaacuuacaagaagaguagacaugauggaacugugaca

SEQ ID NO: 2244257 - RNA, 84 nt, Homo sapiens
ggcccagccugccaaggagucagucccuagagaucuccaggagaagcccuucuagggagacgcccuggucuaggcauguggguc

SEQ ID NO: 2244258 - RNA, 76 nt, Homo sapiens
uuccccugguagguucucaggaaugagcuucccacccuugcugggaggaugcagcucgaaaccagcccaaggggaa

SEQ ID NO: 2244259 - RNA, 79 nt, Homo sapiens
uuggagauggugacaguaaacagucuugauuauggucuaauaugaccauugagggggaauauuacucuuaccuugccag

SEQ ID NO: 2244260 - RNA, 65 nt, Homo sapiens
uuuuuaagcuccuuugaugucaggcauuauuucuugcucuucuugccugacauugagcugagaaa

SEQ ID NO: 2244261 - RNA, 73 nt, Homo sapiens
guagggauagagcuggcagacacccuuaauggcauucuuccacuuuugauggcugccagacugcuguuuuuau

SEQ ID NO: 2244262 - RNA, 90 nt, Homo sapiens
ucucauucauguccacccagaacaucaguauguggcuuuaucuggaaauagggccuuuguagauguacucaguuaaggacugugaggaga

SEQ ID NO: 2244263 - RNA, 127 nt, Homo sapiens
guguugguuauaugauguuuuccauucugaggauuuugccuuuuuaaaaguauaggccuggcauaaauuugaagaguauaggccuggcauaaauuuuuauguaaagauuaaggguggugauuaauau

SEQ ID NO: 2244264 - RNA, 62 nt, Homo sapiens
uggccaguugaagacaaugcucacuuacuacgagauaaugugcguguugucugaagcugcua

SEQ ID NO: 2244265 - RNA, 101 nt, Homo sapiens
ugagacacaagaaucguuugaacccgggaugcagagguugcagugaacugagaucaugcaacugcacuccagccugggugacagagugagacucugucuca

SEQ ID NO: 2244266 - RNA, 107 nt, Homo sapiens
uccugauaagauaagcuaaugaauuccagaugggaguucuauucuauuucuccagaaacccagagaagagcucuuucuaggccacagcagccuaucaggaagcagga

SEQ ID NO: 2244267 - RNA, 79 nt, Homo sapiens
uaaacuuuguaacucugaauacauccuacuugcaagucucuauguaauguaguauccggaguuugauagaauugguuug

SEQ ID NO: 2244268 - RNA, 98 nt, Homo sapiens
ugggggaggaucgucugagcccaggaguuugaggcugcagugagcuacaaucacaccccugcacucaagccuggguuacagagugauaaccugucuca

SEQ ID NO: 2244269 - RNA, 66 nt, Homo sapiens
ccagauaggcgguguccuccaagugcuuccgggucaucuggagaaucuggccauacugcugauugg

SEQ ID NO: 2244270 - RNA, 57 nt, Homo sapiens
gcuuggggcuccuguaagcaagaacucaaagguccuugagaggacagagccauaagc

SEQ ID NO: 2244271 - RNA, 97 nt, Homo sapiens
gcucuggguuccucacagugaguggaguggggugugaggcagccagugagcuuccaagccucccucccuggcugugggacccuaaguagcccagagc

SEQ ID NO: 2244272 - RNA, 98 nt, Homo sapiens
ccaauugcucacuauauugcuugaggccaggaggugucaaccuccuggaguuagguaucuggucaaccuccuggccucaagcaauccuccugccuugg

SEQ ID NO: 2244273 - RNA, 100 nt, Homo sapiens
ggauuagaugaguuaaugcauguaaugggcugauagugccuggcucauagcaagcacauaaccaaugucagcuauuaguauuauuaaaaaauuuugaucu

SEQ ID NO: 2244274 - RNA, 75 nt, Homo sapiens
gcaaaccaaaaaccugacuuuuauucacuauuagacaaaagucuuauacaugugcaggucagguuaccuguuugu

SEQ ID NO: 2244275 - RNA, 86 nt, Homo sapiens
uuauacagaaucaugcauuaagagaacaugcacauaaggcaaaaugaugacugcauggccuuuaaaugucacagaguacugucuaa

SEQ ID NO: 2244276 - RNA, 96 nt, Homo sapiens
gaggugggaggaucgcuugaaccugggggcgggaguugcagugagccaagaucaugccacugcacuccagccuucaggacagugagacccugucuc

SEQ ID NO: 2244277 - RNA, 58 nt, Homo sapiens
uuagacuuuaaggauucuaaucuuuugggauuucaauauuuggaauuuuagaguuuga

SEQ ID NO: 2244278 - RNA, 58 nt, Homo sapiens
ugagaugaggucucacucuguugcccagguuggaauacagugguguagucucagcuca

SEQ ID NO: 2244279 - RNA, 68 nt, Homo sapiens
guacccuauggauauagaugaauggcugcauuuuguugaggauuuuugcaucuauguucaucagggac

SEQ ID NO: 2244280 - RNA, 61 nt, Homo sapiens
gcugagagggaugcuuaauaguguuacacaggaagugacacagugggggauccuuuucagc

SEQ ID NO: 2244281 - RNA, 58 nt, Homo sapiens
guuccuuaacaguuuccucucauucagacacaacuucaaugaagugaaguuagggaac

SEQ ID NO: 2244282 - RNA, 71 nt, Homo sapiens
gggacauuuauugccucaauuccaagacugccuggaaaagggcgguacugccuugggcaguagagaguucc

SEQ ID NO: 2244283 - RNA, 100 nt, Homo sapiens
guccuguagaaauguauuuugacaucauuaugagauuuaaacaaauuccucagugaauguuugguugugauauguuaaccugcaaguuuugaacauugac

SEQ ID NO: 2244284 - RNA, 94 nt, Homo sapiens
gaggcaggagaaucacuugaagccaggaggcggagguugcagugagcugagauugugccacugcacuccugggugauagagggagaccugucuc

SEQ ID NO: 2244285 - RNA, 97 nt, Homo sapiens
cugcccccaucuuugccaugucauagguuaagccugcucagacuuuaaccuaugaagcaggcuuaaccuaugaaguggcaaagauggccacaagcag

SEQ ID NO: 2244286 - RNA, 83 nt, Homo sapiens
acccaaaguggguagcuccuuucugcaggcaggucauuccaaucaguguccagcucucagcagagaggaaaccugcagugggu

SEQ ID NO: 2244287 - RNA, 73 nt, Homo sapiens
gucucgaaaggucccugcccaucccuuaagcuuggacccagggaagcuucaaguuggaagggaccuaagagac

SEQ ID NO: 2244288 - RNA, 71 nt, Homo sapiens
gaccccaugaucucacuucugcguggaauccaaaaaguugaacucauaaaguagaaaguagaguggugguu

SEQ ID NO: 2244289 - RNA, 66 nt, Homo sapiens
ggcaggugagagcucuuugaaaaugaaaacauucugcuauuugaaugcaaaguguucuucuuugcc

SEQ ID NO: 2244290 - RNA, 93 nt, Homo sapiens
ccucuugauggaucacaauucucaauuugugaaacacuugucaaaggcaagcuccucauuucauagaugagaaugcugagacccagagagggg

SEQ ID NO: 2244291 - RNA, 84 nt, Homo sapiens
agauguaugaucucugaauguucuuaaaacccuuguaauucccugaguaauaagggugcuaggagcaucuuaguucuaauguuu

SEQ ID NO: 2244292 - RNA, 109 nt, Homo sapiens
ccagaacagauaguguuuaauuccacuuugucugugucuguuugagcugcuaucacaaaauaccauagacugaguggcuuaaaccaacauuuacuucucccacuucugg

SEQ ID NO: 2244293 - RNA, 58 nt, Homo sapiens
ugugucugggcaggguaauuuugaaugacaucauucaaagugcauguucccacuugca

SEQ ID NO: 2244294 - RNA, 74 nt, Homo sapiens
gguuggugcaaaaguaauggcgguuuuugccauuucuuucaauggcaaagaugaccauuacuuuugcaccaacu

SEQ ID NO: 2244295 - RNA, 59 nt, Homo sapiens
guacauguugacacgggauuguauagguguaguucccuucucuucccugugacaugugc

SEQ ID NO: 2244296 - RNA, 58 nt, Homo sapiens
ugauuuguuuagugccaaguuuccagaagacaacaaagugugguacuaaaugaaauca

SEQ ID NO: 2244297 - RNA, 66 nt, Homo sapiens
cuauaauacugaaaguauuuucaaaucuaggaugaccaggauagaggaauuguucaguguucauag

SEQ ID NO: 2244298 - RNA, 59 nt, Homo sapiens
gggaguggcagguuauaugguaauauaugguaauaugucaucauuggaaucugccuccu

SEQ ID NO: 2244299 - RNA, 87 nt, Homo sapiens
ccucgucuaauuucauugguuaguuaacuuuaagaaaauguuuuucugcaugagucaaguucaucagccagauugcuguuggugagg

SEQ ID NO: 2244300 - RNA, 128 nt, Homo sapiens
gagcccucacuaauauagcaauauaugugucauuugucucacuaguaaggcuguuuaguagucaaaacuguagaaaauugaauauacacuuacuguauaaaaaugauaugcuugguuagugauaguuu

SEQ ID NO: 2244301 - RNA, 67 nt, Homo sapiens
ugggugaguaucuauuauucagcugcauuagaaguggcugguuaggucgguaguaguggcucacuca

SEQ ID NO: 2244302 - RNA, 100 nt, Homo sapiens
acauucagucuucuguucaaaguacauguauuaagcaucuauuuuauauuaagcugugaguuagguguuuuaaauauaaagauagauaagacaugaaugu

SEQ ID NO: 2244303 - RNA, 81 nt, Homo sapiens
cuucaagucaaccuauacugucagcaccaggacccacuaaacuuacuguaggaaauuggucacugacauguuugaaagaag

SEQ ID NO: 2244304 - RNA, 108 nt, Homo sapiens
gcagcuacacugguuucccuggugaguugacuuugaaugaucuuggcaaguaaauaggccugagauaguguggguacagcuauucugaaaggcaagaagguagacugc

SEQ ID NO: 2244305 - RNA, 74 nt, Homo sapiens
gcuggaugcuucuuggcgaucauggcaguagccuccugaaugauagucuugagaagcauuuugacuaacccagu

SEQ ID NO: 2244306 - RNA, 76 nt, Homo sapiens
agaauucagcaguauuucuccuacucacacauccgucuauaggcuuucugugagaagaaaaauauggcuguauucu

SEQ ID NO: 2244307 - RNA, 77 nt, Homo sapiens
cuaguauucauauggaagugccaauuuuaaggaaauagggaguagaaaagggugagcgcauugauguuggaugcugg

SEQ ID NO: 2244308 - RNA, 64 nt, Homo sapiens
caacagugcauucagggauauaucucacuuggucaugguguauaaucuuuuaaauguacuguug

SEQ ID NO: 2244309 - RNA, 61 nt, Homo sapiens
ugcccauuuuaugguugaugaaacugagaucagguuguaacuugucccagccauagaggca

SEQ ID NO: 2244310 - RNA, 130 nt, Homo sapiens
gugaauagguuaugugagaggugacuggguuauuugggaggugacugguuuaucuggcagugacuggguuaucugguaggggugacuguuaucggggggugaguugguuuaucuggggugccuggguugu

SEQ ID NO: 2244311 - RNA, 71 nt, Homo sapiens
gaugacauugaaaagcaaguggacuuaaauugcauaaucagaacuuauauucauagcuuuuuggucucauc

SEQ ID NO: 2244312 - RNA, 55 nt, Homo sapiens
ugggugugacugacuguguuucuggaugagauuaacauugaacuuggcacaccca

SEQ ID NO: 2244313 - RNA, 58 nt, Homo sapiens
gcccaggagcuggaggcugcagugaguggagaccgcgccguugcacuccagccugggc

SEQ ID NO: 2244314 - RNA, 78 nt, Homo sapiens
ggccuagugcuaagguauuucuaugggaauagauuuucauuuuucucggggaaauauuuagaaugaaagugcuagguc

SEQ ID NO: 2244315 - RNA, 55 nt, Homo sapiens
uucccucagaaacacacagcccagcagcuccugcgguugugugguuuugcgggaa

SEQ ID NO: 2244316 - RNA, 76 nt, Homo sapiens
uauacuuuaaguuuuaugguacaugugcacaaugugcagguuuguuacguauguauacaugugccauguugguaug

SEQ ID NO: 2244317 - RNA, 76 nt, Homo sapiens
aauugccugucacagggguuugauguacagauuauuuuguuacccagguaauaagcauaguaccugauagguaguu

SEQ ID NO: 2244318 - RNA, 59 nt, Homo sapiens
ugagaucgaguuucgcucuuguugcccaggugggagugcaauggcgcaaucucggcuca

SEQ ID NO: 2244319 - RNA, 95 nt, Homo sapiens
aaggcagagaccugauucguacaguaguaaaagugaaugaacauuggcaacauuuauucaccauuuauuaugugaaguccugaaaauccugccuu

SEQ ID NO: 2244320 - RNA, 69 nt, Homo sapiens
cgguugauugaaauaucaguuaaagguugccagcaugguugcagauaaacugauguuugaaauucgcug

SEQ ID NO: 2244321 - RNA, 113 nt, Homo sapiens
uuuuuuguuuauuaagguguuuaaauaagcucagcuaauucaagacacuguagccacuugugcaucagugugcuugaauuuaguagcuuacagcauuauuuaugaaggaaaaa

SEQ ID NO: 2244322 - RNA, 129 nt, Homo sapiens
gggaaguauuugucaaugguaaggacaucuuuuuggggugauaaaaauguucuaaaguugauaguguuaaugacuguacaacaguuuuaucaccccagaaagauguccauaccauugacaaauacuccc

SEQ ID NO: 2244323 - RNA, 66 nt, Homo sapiens
gccaggcaaaggcuuccacugcauccuuccaggcauguggaggauaaacacggagcuuccccuggc

SEQ ID NO: 2244324 - RNA, 81 nt, Homo sapiens
gguaaguuagacaacauuugcuuaaagacaaagucugugcuucagaaacagcuggucugccguaguaggugcugacaugcc

SEQ ID NO: 2244325 - RNA, 75 nt, Homo sapiens
aaaaaucugguuuuugcuuggccauugcaauuaagugauuuucugcuuuugcagugucaauaauaauuaguuuuu

SEQ ID NO: 2244326 - RNA, 70 nt, Homo sapiens
aagucuuugcuauugugaauagugccgcaauaaacauacgugugcauaugucuuuauagcagcaugauuu

SEQ ID NO: 2244327 - RNA, 82 nt, Homo sapiens
uuuguuuauugugauuaucuuucauauaacaaugugcuuaaauagcuggugguucuugauaggucacucaacagugagcaaa

SEQ ID NO: 2244328 - RNA, 85 nt, Homo sapiens
ugaugccucccacauuuugaggacuagaccagugauuccuaaccauucuuuuuucauuggucccucugaaaauugggugaaauca

SEQ ID NO: 2244329 - RNA, 102 nt, Homo sapiens
gccguggagcucucugugccacgcugcggggccucggucugaccagcagggggcaccgaguguucucccgcagcggcccggcgugggcggcggcuccaaggc

SEQ ID NO: 2244330 - RNA, 89 nt, Homo sapiens
aaaacuucagagauguucaccuguagcuaagaccuaaucagggcucucuuaauuaggacuucauuacuggugaacaucucugaaguuuu

SEQ ID NO: 2244331 - RNA, 64 nt, Homo sapiens
auugugaguagugcuguaauaaacauaugugugcaugugucuuuauagcagcaugauugauaau

SEQ ID NO: 2244332 - RNA, 59 nt, Homo sapiens
cugacugagccugugcagucacacaccugugaagucauuucugcaagguaauaggucag

SEQ ID NO: 2244333 - RNA, 55 nt, Homo sapiens
gagcacauaugacauuuucuucuuaagaagagggaauugugucauguguauguuc

SEQ ID NO: 2244334 - RNA, 72 nt, Homo sapiens
cacaauugucagugcuguuuaaauuguauccucucucucucuuaauugaacuuuugucacugacauguugug

SEQ ID NO: 2244335 - RNA, 77 nt, Homo sapiens
cacugugggccuuggucugugauaugugcuggcuucaggugugacgcagcacauucacagcuaugguggccauggug

SEQ ID NO: 2244336 - RNA, 66 nt, Homo sapiens
agaaagguuuaccucugugagcugcaucaauacaucacaaagcagucucacagacagcuucuuucu

SEQ ID NO: 2244337 - RNA, 56 nt, Homo sapiens
uuaagccacucaagagauagagcacuuccccuuugcucuguguuucagcugcuuga

SEQ ID NO: 2244338 - RNA, 63 nt, Homo sapiens
ggcuuguguauuaucucugaaucaccugcuaccuuggcauucuuucaguagugcacauaagcc

SEQ ID NO: 2244339 - RNA, 90 nt, Homo sapiens
ugcuaugaaacagcaucaagugcuacagagaaaucuuucacgaaagaaagaggcaaucaauguagcaaacuucauuguugucuuauugua

SEQ ID NO: 2244340 - RNA, 88 nt, Homo sapiens
ggaggggacauaagcucaauuuccuggaggggaaguguccaaauacacuauuuggaguucuucuaucaggacauuuugucccaucucc

SEQ ID NO: 2244341 - RNA, 60 nt, Homo sapiens
gaaguucuacuguggguaaaaugcuguccaauagcaccacauacuacagagauaugcuuc

SEQ ID NO: 2244342 - RNA, 130 nt, Homo sapiens
aauacaguggguccuagccacguguggcuaucaagcaccugagauguggcuagagagguugaggaacucaauuuuuaacuaaucuacaucuaaauuuauauagccacauggggcuagaggcuccuguguu

SEQ ID NO: 2244343 - RNA, 75 nt, Homo sapiens
gauggucuuggacaagauugcagagaauucuccagauuuuuaggagagagauuuuuguucuucucccuuacuauc

SEQ ID NO: 2244344 - RNA, 96 nt, Homo sapiens
acauucacccugcacacucauucucagguuagaacuuagggcacaaaaugucaguugugcaaggcucucaaccuguguguguauggaagugggugu

SEQ ID NO: 2244345 - RNA, 57 nt, Homo sapiens
cauagaaggcagauuugcucacaucucuuccuagagugagcuaguuucuuugcugug

SEQ ID NO: 2244346 - RNA, 76 nt, Homo sapiens
aauauuaugaaccauccaguccuaugagucaugccuuuuuuugaagcauugcacuuggcauagacugcauaguauu

SEQ ID NO: 2244347 - RNA, 58 nt, Homo sapiens
gugcuuuacaaacuauaaagugcgguacaaauaucguucuugucaguuuauaaagugc

SEQ ID NO: 2244348 - RNA, 96 nt, Homo sapiens
gacaugaacuuccaguauaauguuuaauguuagugguaaugaaaagcauccuuguauugcuucugauuuuaaaugagugcuuuaagauuuuauguu

SEQ ID NO: 2244349 - RNA, 73 nt, Homo sapiens
cugguugaucuugauuuugugagcagguuaucaauaucaauucaugauauugccugucuccaaaaaucacugg

SEQ ID NO: 2244350 - RNA, 72 nt, Homo sapiens
ggagggaguuuagaaagcaggacaaggaagaaacagauuucuuuuuggucuccaguuucugcugcuuccuuc

SEQ ID NO: 2244351 - RNA, 61 nt, Homo sapiens
guucaaacugcuugaggccauuuagagccaaagcugcuaguggcugcagggcuguuugaau

SEQ ID NO: 2244352 - RNA, 99 nt, Homo sapiens
ggucccagcugccuaugcugcugcauuggggauuaaguuuccaacacaugagcuuugagagacacauucaaaguguagcagggagcagugggaaagacc

SEQ ID NO: 2244353 - RNA, 66 nt, Homo sapiens
aggaaauccaguuuggaggcuugauguggguuuugaccuggccucagccuuggggcuguuuuuccu

SEQ ID NO: 2244354 - RNA, 79 nt, Homo sapiens
aauuauccagucucagguaguuccuuauagcaaugcaauaauggauuaauacagguacuaucuucgaaguuugaugauu

SEQ ID NO: 2244355 - RNA, 121 nt, Homo sapiens
gaguggaaguacugggaaaaaggguauauauauuuugaauuuugauugauauuacugaacuccccuuucaaagagguuauagaguguauacuaccaugacauuaucuccgauuaucuauuu

SEQ ID NO: 2244356 - RNA, 79 nt, Homo sapiens
auaugaaaucguauguuauuuugcugauacccgaugggcucccaaccauuucagcaccauguaacaauugauaguauau

SEQ ID NO: 2244357 - RNA, 90 nt, Homo sapiens
ucaguuuucacucugucaauauguaauaacugaaucugucuuuguggugaggauucagugaguuaacauauuugaagugcuuaaaaauga

SEQ ID NO: 2244358 - RNA, 59 nt, Homo sapiens
uucagacugggugaagaggguauccccacaggagaagagcccuaauauugaguauugaa

SEQ ID NO: 2244359 - RNA, 107 nt, Homo sapiens
guggagaggagacccaugguggguagcuccuuucugcagguagguuggcccaauggcuguccagcucucagcagaaaggagaccuguaguggguagccccuuucugc

SEQ ID NO: 2244360 - RNA, 64 nt, Homo sapiens
uuugguuugccaguauuuuauugaggauuuuugcaucaaaguucaucagggauauuggucuaaa

SEQ ID NO: 2244361 - RNA, 71 nt, Homo sapiens
auagccugguaguuaucuugagguaggugugacuucagggucacagauaaauaaagaugauuaccaucugu

SEQ ID NO: 2244362 - RNA, 70 nt, Homo sapiens
gcaggaaaggugggauauguucuuucacguugguggcauuucaccagugucaaaggacauacgccucugc

SEQ ID NO: 2244363 - RNA, 57 nt, Homo sapiens
cagaccagaaagcagugaccaguaggcugaauuuggcuaguggguguuuucuguuug

SEQ ID NO: 2244364 - RNA, 69 nt, Homo sapiens
agacagcuaauuaugagacuucucagccuccauaauugcaugagcaagaucuuuauaauuagucuaucu

SEQ ID NO: 2244365 - RNA, 68 nt, Homo sapiens
gacucaguguggugggcauuugggugggacaauuccacuuuguacaagacuguccaacauauuggguu

SEQ ID NO: 2244366 - RNA, 58 nt, Homo sapiens
gguuggaggugggaauagcuaguuauccaugacccaauuuauagcucuauuucuagcc

SEQ ID NO: 2244367 - RNA, 63 nt, Homo sapiens
ggaaacugaauguaaacacggaguguuuuaaggacucugacuuuugguguuauaucaguaucc

SEQ ID NO: 2244368 - RNA, 79 nt, Homo sapiens
gaucagaguagcugucguuuuuuccuuuacugcagaauuauuauuuuaaguaaaugaaagguugauuuauaucugcauu

SEQ ID NO: 2244369 - RNA, 78 nt, Homo sapiens
augaggaagagagaaaagugugugcagagggcaggaagaaagcccaagcucugugcauuacacuuuucucagucucau

SEQ ID NO: 2244370 - RNA, 63 nt, Homo sapiens
uggcaagaagagcaugagaccacucuaguguauacccugcuaagucucagcucuccuaugcca

SEQ ID NO: 2244371 - RNA, 95 nt, Homo sapiens
aaucuugccuacuacuguuguuuuggggcagauggaauaaaaaauggugaguggaaacguccauuuguuuccagagcacuucauuggaggagauu

SEQ ID NO: 2244372 - RNA, 81 nt, Homo sapiens
uucuuuuggauauugacuuauucuauguuuuauuuuagaagacagaauugauauaagguuuaagucuaauauguagaagaa

SEQ ID NO: 2244373 - RNA, 96 nt, Homo sapiens
auuuauguauguauguauguauguauguauuuacuuauuuauuauacuuuaaguucugggauacacgugcagaacaugcagguuuguuacauaggu

SEQ ID NO: 2244374 - RNA, 76 nt, Homo sapiens
ugagcauaagugcuucagaagacaauauuuuccaaaaaaguuucaaggugaauauuucuaauguggcaucuguuca

SEQ ID NO: 2244375 - RNA, 57 nt, Homo sapiens
caggagagguggagcucaggugguaaugcuugcucaccugcugcucaccuccugcug

SEQ ID NO: 2244376 - RNA, 82 nt, Homo sapiens
caaagaugaauaaagcaggguccuugcacuagaggaaaccuugaggauucagaagugaaggcacucauuuuaucuaucuuug

SEQ ID NO: 2244377 - RNA, 66 nt, Homo sapiens
uuuagaguaguuuauuaugcuaagggccugggaaacacuuuagauucaguaaaaaaacuaccuaga

SEQ ID NO: 2244378 - RNA, 85 nt, Homo sapiens
ccaguaucugugaaugugaccuuauuugggaauagcaucuuuaacgauauuuaaauuaaguugagguuauaauggauuagcaugg

SEQ ID NO: 2244379 - RNA, 98 nt, Homo sapiens
uguaagugaaagagagaugcuggaguucauggaaccaagacuaucaauugguauuaauagauaguuaugauuugaugauuuuacuuucuaaacuaaca

SEQ ID NO: 2244380 - RNA, 115 nt, Homo sapiens
uauauguccauacaaacaguuguauacaaacuagcaacauuguucauaauagcugaauucauagcagcauuguucauaauaguugaaaaguaaaagcaacucauuaagauauaua

SEQ ID NO: 2244381 - RNA, 82 nt, Homo sapiens
gcuggagugcagugacaguggagacuuacuucagccuccaccucccaggcucaagugauucucaugcuucagccucuccagu

SEQ ID NO: 2244382 - RNA, 73 nt, Homo sapiens
cuuggccuauuccagcagcuguggacuccuaacaguuuuccccacucacuuacagcugcagaaucaggcuaag

SEQ ID NO: 2244383 - RNA, 62 nt, Homo sapiens
agcaagauugauggccugcaggcaugacuuaacccuugccuggcaugguccuagguuuuguu

SEQ ID NO: 2244384 - RNA, 70 nt, Homo sapiens
aauguggguaaaucucuuuucauggcuuucagcucugaaggccgucagccccgauuugccacuccacauu

SEQ ID NO: 2244385 - RNA, 69 nt, Homo sapiens
gaugaaauuaaauggaauuuauugggaauauagauaauuuauuccaaauuagaugcauuuagauucauu

SEQ ID NO: 2244386 - RNA, 65 nt, Homo sapiens
uuaaccgagaugguuaaggaagauuccauaaaggaauuaaaauugaacuuccuuagucugguuaa

SEQ ID NO: 2244387 - RNA, 61 nt, Homo sapiens
guagaaugauauguuauguuuagguugccaauauuggcaaccuaaaauuuauauuuuuugc

SEQ ID NO: 2244388 - RNA, 112 nt, Homo sapiens
ugccuguggcucccuccacagggaucccuugcaugcacaguucucaauaggguccgcgcuccuaugagaaucugaugcagccaccgaucugacaggaggcagagcucaggcg

SEQ ID NO: 2244389 - RNA, 58 nt, Homo sapiens
gaagugggagugacugaggcucaauuuaccccugugcgguuucacacucgccuacuuc

SEQ ID NO: 2244390 - RNA, 71 nt, Homo sapiens
gccucugcucgugagaugagggaagccuaggcaguacaggcucccuggcuucuuuaaucuagaggaggggu

SEQ ID NO: 2244391 - RNA, 80 nt, Homo sapiens
ggcuggaguauggcggugugaucuuggcucacugcaaucuccucugccuccugagcucaagugauccucccaccucagcc

SEQ ID NO: 2244392 - RNA, 92 nt, Homo sapiens
gagguauccacuuauugagcuuuuuacuuguccaauuugcuucaaauguggaacaauuguagaaugguugacuugaguucuucggaaacuuc

SEQ ID NO: 2244393 - RNA, 63 nt, Homo sapiens
gucugcugccuuuuguacagauaugcccugcccccagagguggaaucuagagaggcaguaggc

SEQ ID NO: 2244394 - RNA, 55 nt, Homo sapiens
cauugcccugaauuugugaaucaucucugaugauugcagaaucacagagguagug

SEQ ID NO: 2244395 - RNA, 83 nt, Homo sapiens
cugguaagucuuguaggcaguuucaugagguaguuaaugauguccaguguaugaaauugcuaucgcaguacuauuacugccag

SEQ ID NO: 2244396 - RNA, 66 nt, Homo sapiens
gcagaucaccaggauuuuucagccuugcagcucugauuugcauaggcuaaaauccuggccaagugc

SEQ ID NO: 2244397 - RNA, 60 nt, Homo sapiens
ugugaauagugcugcaauuaacauacaugugcaugugucuuuacagcagcaugauuuaua

SEQ ID NO: 2244398 - RNA, 58 nt, Homo sapiens
uuuucuaaaauauccaggacagucuuuggugaauaggucuugguauguauuuaggagg

SEQ ID NO: 2244399 - RNA, 93 nt, Homo sapiens
guggugcauaccuguaaucucagauacuugggagguugaggugguaggauugcuugagcucaggaguuugaggcugcaguaagcuaugaucac

SEQ ID NO: 2244400 - RNA, 82 nt, Homo sapiens
gugguuuuugucuuugguucuguuuauaugcuggauuacauuuauugauuuguguguguugaaccagcaggaugaagcccac

SEQ ID NO: 2244401 - RNA, 58 nt, Homo sapiens
gauguugaauuguucuuaaagacgaaacagaguucuugauguugaauuguucagcguc

SEQ ID NO: 2244402 - RNA, 69 nt, Homo sapiens
aacuuuagguagucaaagguuaguccuuguggucuaagguugcauugauaaucuuugguauuuaaaguu

SEQ ID NO: 2244403 - RNA, 58 nt, Homo sapiens
ccacagucuaugcaacaagguccagccagaugaagccuguagccagguagaacugugg

SEQ ID NO: 2244404 - RNA, 64 nt, Homo sapiens
cuucaggugagcaggagauaaacagguaggauucaaggcuuaccagucugauuccuguuagaag

SEQ ID NO: 2244405 - RNA, 59 nt, Homo sapiens
ugagacgggagucuugcucuguugcccaggcuggaguguaauggcaugaucucggcuca

SEQ ID NO: 2244406 - RNA, 81 nt, Homo sapiens
uuuaucaugugauaacauuucuucugguacacuugcacauaagaaagcuguauagaugaaaagauguugcaauuggaugaa

SEQ ID NO: 2244407 - RNA, 55 nt, Homo sapiens
uuggcagucugaggcacagacuggaugaaaaccuuuuucuauuuuaggcugucaa

SEQ ID NO: 2244408 - RNA, 79 nt, Homo sapiens
ucacucuguugccuaggguggagugugguggcaugaccuugguucacugaaaccgccuccaccucccagguucaaguga

SEQ ID NO: 2244409 - RNA, 82 nt, Homo sapiens
ggggaggcccagugucugacagacacggcggcaggccugggacaaggggacagccgcacguguccugugggaacuccacccc

SEQ ID NO: 2244410 - RNA, 79 nt, Homo sapiens
auugcaaugcauugcaaaucucuuguguuugguugcaaacuuucaacugaaacacugagugaauuguugccucugcaau

SEQ ID NO: 2244411 - RNA, 87 nt, Homo sapiens
guccacagagaucagcaguguugugauccaggucuucuauuuuaagggacauauauaagacagaugcaaccugcuagcuauggagac

SEQ ID NO: 2244412 - RNA, 68 nt, Homo sapiens
gaggcggguggaucacuugaggucaagaguucgagaccagccuggccaacauggugaauccccgucuc

SEQ ID NO: 2244413 - RNA, 61 nt, Homo sapiens
aguuuccugaggccuccccagaagcagaagccacuuugcuuccuguacagccugcagaacu

SEQ ID NO: 2244414 - RNA, 98 nt, Homo sapiens
cuucucaguacucaaacagaugccccauguaucaugaaguuucuucauuuugcuauuaaaauggaagcuauuuaugauucugaaggagcucugagaag

SEQ ID NO: 2244415 - RNA, 90 nt, Homo sapiens
ugugucaggcagaaugcuauuagguuggugcaaaaguaaaaguuauuccacaauuacuuuugcaccaaccuacuauaugcugaggauaca

SEQ ID NO: 2244416 - RNA, 67 nt, Homo sapiens
uuucauccauaggacuucuucagggcacgcaauccucucaaaugaagugagcuccaauugggugaga

SEQ ID NO: 2244417 - RNA, 55 nt, Homo sapiens
cccuaauccguaagugucuuguuuacuuuggugagaguagggguugggauugggg

SEQ ID NO: 2244418 - RNA, 130 nt, Homo sapiens
uugaguaucauggaugaagcauauuaugacucccugaggauggcagaaggaaaggauuguauugaaaaguugguuauaaccauuucuucucucuucaaggggauaagaugcaucaauaaaguguucucag

SEQ ID NO: 2244419 - RNA, 67 nt, Homo sapiens
gugacccucuagauggaagcacugucuguugucuaagaaaagaucgugcaucccuuuagaguguuac

SEQ ID NO: 2244420 - RNA, 69 nt, Homo sapiens
guugcuugcaauugaaaaauuuuuaaacaauacuagcaguacaguggaauugcaucaaaugcagguagc

SEQ ID NO: 2244421 - RNA, 58 nt, Homo sapiens
ugcacuuuuuugauuagcguauagguuggcauucuguggcauuuucagaaaggaugca

SEQ ID NO: 2244422 - RNA, 78 nt, Homo sapiens
agaagacuuugguaaacucgguggcaaaaagggcuaugcacaguccaaugccaacccagacuuucccagagguccucu

SEQ ID NO: 2244423 - RNA, 55 nt, Homo sapiens
gcacucuuugguaugguaaccacuaccauguggucacugagcacaggagaugugc

SEQ ID NO: 2244424 - RNA, 76 nt, Homo sapiens
gagucucuguugccuaggcuggagugcaguggugugaucuugguucacugcaacaccuccuggguucaagugauuc

SEQ ID NO: 2244425 - RNA, 111 nt, Homo sapiens
agaaggugccauuuaggaauuuuauaacuaaagagaagucaaugucuggguucaaagcuucaaaggacaggcugacucucuuuuuagugguuaaugccgguggugacuuuu

SEQ ID NO: 2244426 - RNA, 120 nt, Homo sapiens
cuuacuauucacaaacacaucaaggaauuuuucuuuaaucaggucaaaauaaaguauuuucuaacacugauauauugaaugaugaaacagaguccuuugaggauuaaaugaaguaguggg

SEQ ID NO: 2244427 - RNA, 104 nt, Homo sapiens
gaggugggaagacugcuugagcccaggaauuggagucugcggugagcuaugaccagaucauaccacugcacuccaguuucgguaacagagcuagacccugucuc

SEQ ID NO: 2244428 - RNA, 55 nt, Homo sapiens
uugaaguauagaguuuaagaaccaguaaauuuagguuugcaauuugauacuucag

SEQ ID NO: 2244429 - RNA, 70 nt, Homo sapiens
cuguauguucaggcagaaguuugcugcaggggcagagcccucauggagaacuucugcuagggcagugcag

SEQ ID NO: 2244430 - RNA, 67 nt, Homo sapiens
ggcacuuaaugcauaauuuguaugagguaaaguguuugccucaaaucacuguguaaaagucagugcc

SEQ ID NO: 2244431 - RNA, 75 nt, Homo sapiens
uaaauauccuugagauuuucagcuugacugggagaagaauuuuuuccaccagcugaaaaucaguaagcccauuua

SEQ ID NO: 2244432 - RNA, 74 nt, Homo sapiens
guuaugauauagaccuggagaguagauauacccugagguagaacaguauauuagcuugauagggcuuccauaac

SEQ ID NO: 2244433 - RNA, 55 nt, Homo sapiens
guauacaguugacccuugaaccgcacagguuugcgguucgcagguccacuuauac

SEQ ID NO: 2244434 - RNA, 56 nt, Homo sapiens
auccauugucuaaugcuaagauggugaggcaauagcaccucuuaaauacagugggu

SEQ ID NO: 2244435 - RNA, 60 nt, Homo sapiens
uguuucauauaguagugguucuacccauccagauagacugaaucaccauuauuuggaaca

SEQ ID NO: 2244436 - RNA, 68 nt, Homo sapiens
ugagauuuuggggggaccagggacagaaugcuauaguuuggauggauguuuguccccucuaaaucuca

SEQ ID NO: 2244437 - RNA, 76 nt, Homo sapiens
auagaaaucagguuuucccuccagccuaucaccuaguaggaagauaaggcuuaugguaaaguccuguccucucuau

SEQ ID NO: 2244438 - RNA, 67 nt, Homo sapiens
ucugcacugagcaucuaaccuuauaggcauaucuuccuuucuugugaauguuuauucucggugcaga

SEQ ID NO: 2244439 - RNA, 62 nt, Homo sapiens
uugagagcugaugaaagauaaaggaauuuuugcucguuugucagagauuuauuagcuuuuaa

SEQ ID NO: 2244440 - RNA, 77 nt, Homo sapiens
aggcuagaguaguggcgugaucucggcucacugcaagcuccgccuccugagcucacgccauucuccuuccucagccu

SEQ ID NO: 2244441 - RNA, 66 nt, Homo sapiens
gauguugagcacauguguuaagggguacuuuguuugaaauaccuuauugcuuagugugccaauauu

SEQ ID NO: 2244442 - RNA, 93 nt, Homo sapiens
auagaagaaaggcuuucaguucuucccgauuaugauauuagcugugagucuaucauacauggcuuuuauuauguugagguaucuuucuucuau

SEQ ID NO: 2244443 - RNA, 124 nt, Homo sapiens
uuaguggguaacuaaagguaauggugaguggugccacuuccauuucuacuccuugaguccuggguggaaaucaagggguggaaaugguaguguaaacugguauaauagacuuuuagacuauuaa

SEQ ID NO: 2244444 - RNA, 78 nt, Homo sapiens
agaccagaggucagcaaaguucuccugcagaaggcaaaauagcaaauauuucaggcuuugcuggccaugugguggucu

SEQ ID NO: 2244445 - RNA, 83 nt, Homo sapiens
aaauauaaaccacuguuucaagaagcuuguucagagaaggagaaaagucggauaaucuuguuagaggcagauguagaauauuu

SEQ ID NO: 2244446 - RNA, 105 nt, Homo sapiens
gcuacaugucaggauggaucuaauaugccacuucucuaagucauguauuugaaaugccacuuauguugaccuuuaaguaguauguuugauuucugauaauauggc

SEQ ID NO: 2244447 - RNA, 78 nt, Homo sapiens
cccagacugucccagugagacaugugaacuguaguucagcagaagugugggcaggggacacaugcucaggacccuggg

SEQ ID NO: 2244448 - RNA, 55 nt, Homo sapiens
gggggacuggccaugcucuaugaguuaguuuaauggaguguagaagccagccucc

SEQ ID NO: 2244449 - RNA, 90 nt, Homo sapiens
ggacacuaagcccaaauugccuccuucuucugcaaaguauuguugaggaacaggaagugggaagagggagcgauuuuggagcuuggguuc

SEQ ID NO: 2244450 - RNA, 84 nt, Homo sapiens
gaaucacuuauaccccuucccugugguauagaagccguaggucggcugggcuucuauaccacagggaaaggguguacgugauuc

SEQ ID NO: 2244451 - RNA, 84 nt, Homo sapiens
ccugacuuuuuaaugauugccauucuaacuggugugagaugguaucucacugugguuuugaugugcauuucucugauggccagg

SEQ ID NO: 2244452 - RNA, 72 nt, Homo sapiens
caucuggaugcauuuuugguugucacauuguggagaaguguuacaggcacugaaugcguacaaaucaggaug

SEQ ID NO: 2244453 - RNA, 55 nt, Homo sapiens
gagauguuguucaucugauuguucugagucagguacauggguugagccacguuuu

SEQ ID NO: 2244454 - RNA, 72 nt, Homo sapiens
aaugcuugaauuuggggcuuugguauauuaauuuagauauuauguugaaauguguaagcuccgaaaagcauu

SEQ ID NO: 2244455 - RNA, 59 nt, Homo sapiens
cucuauagauuugccuauucuagacacuucauauaaauggaagcaugcaaucugugggg

SEQ ID NO: 2244456 - RNA, 93 nt, Homo sapiens
gaggauuguuguuuauuuuagguacgcaccggcucaguggauucauauucaaaaagcugagccaguguguaccuaaaauaaacaacaauucuc

SEQ ID NO: 2244457 - RNA, 77 nt, Homo sapiens
uaguuauacugagaaugaugauuuccaauuucauccaugucccuacaaaggacaugaacucaucauuuuuauggcug

SEQ ID NO: 2244458 - RNA, 58 nt, Homo sapiens
gaaaugaauauuuauguaaagcaucuggcacagugggugcuuacugaauguuaauuuc

SEQ ID NO: 2244459 - RNA, 66 nt, Homo sapiens
gagauggaguugucgccugggcuggagugcaauggugugaccucggcucacugcaaccuccaccuc

SEQ ID NO: 2244460 - RNA, 79 nt, Homo sapiens
gagcaggaacucagugccagaaugauacuguuaacgaaagaucucaccaaucuuucucuucaugucguuuuuccuguuc

SEQ ID NO: 2244461 - RNA, 77 nt, Homo sapiens
uucagacaggucacagccaaagcuuuagaccugggagauauccacagacccaugcauggcuguuaacacuguuugag

SEQ ID NO: 2244462 - RNA, 55 nt, Homo sapiens
cuugucacuguuggcuuuagaagccaccuggggauuaggagcagcaggugacaag

SEQ ID NO: 2244463 - RNA, 59 nt, Homo sapiens
gcuucuccagcccuacuggagaaugcccccaucgccggcauuccuagugguugggaagu

SEQ ID NO: 2244464 - RNA, 84 nt, Homo sapiens
guuaguuucuagguagcuuuucugucauguuuacaacuuacaagaaguagaguauauggaugaaaauuacugggaaaagcuagc

SEQ ID NO: 2244465 - RNA, 82 nt, Homo sapiens
acguugaucugcucgguggggaaggccccgaugcccacacgugugguauaggcuuucaccacgccauacacgucaccuaugu

SEQ ID NO: 2244466 - RNA, 70 nt, Homo sapiens
ucugaagugaaaugucaccuuuuaggacuaggccacgccaguccaacauuugcuguuucauucauucaga

SEQ ID NO: 2244467 - RNA, 129 nt, Homo sapiens
ucuuuuuacagucuuauagagcauggaaagcauuuuggauuuuuacuucaacuauggugggaaaccauuaguaguuugaguggggguuaguggcgugaugugauuuauguuuuccaaagauuacuagga

SEQ ID NO: 2244468 - RNA, 127 nt, Homo sapiens
guugugugacauaagaagaucuuggauuaauuagcacuauuuuucacuauccuucuauuaguauuccacugaggaaaugaagaaaaguguuguauuaaauuguaaggauuuaggaacauuaggcaac

SEQ ID NO: 2244469 - RNA, 76 nt, Homo sapiens
uugcuugagcccagaagguggaggcugcagugagcugcauuugcacuacuguacucuacccugggcaacagagcaa

SEQ ID NO: 2244470 - RNA, 93 nt, Homo sapiens
cuuugggacuugagugugcauagauuuugguauaugcaggggucuugggacaaauccccuucauauaccaaaggaugacuaguuaacccaagg

SEQ ID NO: 2244471 - RNA, 63 nt, Homo sapiens
gugaaccccucauuaagcuguuuuuaaagcacgaauuuaagagccgcaagggugaagggucac

SEQ ID NO: 2244472 - RNA, 63 nt, Homo sapiens
gggagauauaugguucuaauaauaauuuacauuuaguagcuauguuuuugcuguguaucucuc

SEQ ID NO: 2244473 - RNA, 70 nt, Homo sapiens
gguuaugauagguuaugauccaucuuggcuggcuuugaacagucuagaccagucuugaccaguuaugacu

SEQ ID NO: 2244474 - RNA, 59 nt, Homo sapiens
uugcaucagcuccugauguacuggccucuaccucacuaugucauacucaguuggugcaa

SEQ ID NO: 2244475 - RNA, 64 nt, Homo sapiens
ugcucugugggugaagacaagggagagugucucauaccucuuuggugaauggucauccagagua

SEQ ID NO: 2244476 - RNA, 94 nt, Homo sapiens
auuuucaauucuuuauucucauccucaggacaaugauggaaucauaguaagguuuucacaauguaaaugaggguuggcauggagggaagggaau

SEQ ID NO: 2244477 - RNA, 63 nt, Homo sapiens
uagguacuugagauucugaacuguggagauuuugaaacauuguuuuuauuucaacgugcacua

SEQ ID NO: 2244478 - RNA, 55 nt, Homo sapiens
uggaaugcuaagcaugugggaguuauuuauauccuacugcucaaggucauugcca

SEQ ID NO: 2244479 - RNA, 66 nt, Homo sapiens
uuucucauuggucugagucaccugguccagugcaggacgggguaggugugaggcagaugugggggg

SEQ ID NO: 2244480 - RNA, 68 nt, Homo sapiens
gaccguggcuaggugguuugaaauacucaagacgaaguuugaaauuggagcuuacuucagccgggguc

SEQ ID NO: 2244481 - RNA, 70 nt, Homo sapiens
uacugagggaggaguguugaagucuccaacugaaaaugcagaucucuucauuucucuuauuucaucggug

SEQ ID NO: 2244482 - RNA, 72 nt, Homo sapiens
uguuagguuggugcaaaagugauugcaaaaaguaauggcaaaaacagcaauuacuuuugcaccaaccuaaua

SEQ ID NO: 2244483 - RNA, 71 nt, Homo sapiens
ucacuucuuuugugauucuucaguuacuucaggccaucuggauguauaugugcaggucacaggggauauga

SEQ ID NO: 2244484 - RNA, 103 nt, Homo sapiens
agggagccuaacaguguugugauuaagagcacauguucuggguuucaguuugaggugggaacuuguuugcuguguguucuugagcccacaaccuaaccucucu

SEQ ID NO: 2244485 - RNA, 72 nt, Homo sapiens
caguuugaguuugaggugcugaugaagcaugcaggugaggcugcguucagggccacugcgaauucagggcug

SEQ ID NO: 2244486 - RNA, 69 nt, Homo sapiens
gcuacaguuaugugagggccaccagguauaaauagaaucugauggcagaauacguaagugugaacaagc

SEQ ID NO: 2244487 - RNA, 60 nt, Homo sapiens
ugugccacugcaccuggccuaaggaaguaguagaauucuuauaaggaaugcagaggcaca

SEQ ID NO: 2244488 - RNA, 77 nt, Homo sapiens
ggcuggagugcaauggcaugaucugggcucacugcaaccugugccuuccagguucaagcgauuguccugccucagcc

SEQ ID NO: 2244489 - RNA, 79 nt, Homo sapiens
uacaggacgucugugcaauucgauggagcucaucacuuuucggucuaugagcaauuaaauugcaccaggaagcccugua

SEQ ID NO: 2244490 - RNA, 55 nt, Homo sapiens
gguagacaucgugcucugugauccccaucgaggaaucucaggaauagauguuacu

SEQ ID NO: 2244491 - RNA, 106 nt, Homo sapiens
uguguguauauauauguauauauaguaugugcauauaaguguguauauauauaguguguguauauauguguguguguauauaaauauguguguguguauauauaua

SEQ ID NO: 2244492 - RNA, 62 nt, Homo sapiens
uagguaucuugguauaucaggaugugaguuagucacuucugaaaacuuucuaggaaagccua

SEQ ID NO: 2244493 - RNA, 87 nt, Homo sapiens
aaauuuuugcauagaccgaugucuuggagcauuuucccuaagcuuuguucuaguaguuuuauagaugugggucuuauguuuaaauuu

SEQ ID NO: 2244494 - RNA, 74 nt, Homo sapiens
uuccacggacaacugcugacaagugaccaguggggauggacaccaccauggcauuugcagaguugaaaauggaa

SEQ ID NO: 2244495 - RNA, 124 nt, Homo sapiens
gaucaugccacuucacuccacccuggacgacagagugacauuccaucucaaauaauaauaauaauaaauucauuagagacagggugucacucuguugcccaggcuggagugcaguggugcgauc

SEQ ID NO: 2244496 - RNA, 56 nt, Homo sapiens
auaauucaaaugccucaagagacgguuaacuuucuuugguaggaaauuugaauuau

SEQ ID NO: 2244497 - RNA, 64 nt, Homo sapiens
guugauuauuuugacuaccaggaauguucuuuucuugaaagaaucucuguuggucagagucaac

SEQ ID NO: 2244498 - RNA, 74 nt, Homo sapiens
uuuuagcauuucuucacucaaggcacucauuuuuaauauugaacuggcaguuuugauguggagagaagcuaaaa

SEQ ID NO: 2244499 - RNA, 87 nt, Homo sapiens
ugcauaacuuuagcaauugauuaugccauauaugaaaauuaaacaugcaugcauacaaaagcauaauacacaguugggaagaaugca

SEQ ID NO: 2244500 - RNA, 91 nt, Homo sapiens
accugguccccaaagaacaucucauucugauuagaggaacugcuccagcacucaaagagagucagauuggcauuuguugggcggaucaggu

SEQ ID NO: 2244501 - RNA, 82 nt, Homo sapiens
ugucguguaguuuucauguauuucacugcuacuagauauuccucagauaucuuugcugagaugcauggcaaaugaacagaca

SEQ ID NO: 2244502 - RNA, 82 nt, Homo sapiens
gaguuaaugggugcagcacaccaacauggcacguuuacauauguaacaaaccugcacguugugcacauguacccuaaaacuu

SEQ ID NO: 2244503 - RNA, 99 nt, Homo sapiens
aguuuuaaguuuugugguacguaguagguuuauaauauuauuuugaauccuuaguuguaauuuuaugucugcugauguguacauaauuuuuauuaaacu

SEQ ID NO: 2244504 - RNA, 66 nt, Homo sapiens
auauucucccauccguacacggauuguauagaggccuucaucuucuuuguugagaugggaaaaugu

SEQ ID NO: 2244505 - RNA, 74 nt, Homo sapiens
cuguauccucagagcccuuguuauguuaucauaugaaugaauauccaugccauagguuuugagaagccauauag

SEQ ID NO: 2244506 - RNA, 55 nt, Homo sapiens
uuuucaagaauggcucauugcugcuacguuccuugagcucaugcauucuugagga

SEQ ID NO: 2244507 - RNA, 58 nt, Homo sapiens
uaaauauucaggugugcccaaaucuuagaagaagaggaagggcaaaucuggaaauuua

SEQ ID NO: 2244508 - RNA, 66 nt, Homo sapiens
cugcagucccucaugcuuuaauggucccuccacgauccugugcgggauuguaaaauaugagggcag

SEQ ID NO: 2244509 - RNA, 55 nt, Homo sapiens
uacaaagcuuugaugugucuuugguggagauuauaugacauauugaaguuuugug

SEQ ID NO: 2244510 - RNA, 75 nt, Homo sapiens
aaaagaauguaacucuccuuuugaucuucagaaaaagagacccccuucugugguugaaaggagagauauacuuuu

SEQ ID NO: 2244511 - RNA, 55 nt, Homo sapiens
uagggaguguccuuucgggaaagguaucuuagccuuuggaauagucuacucccug

SEQ ID NO: 2244512 - RNA, 79 nt, Homo sapiens
aggcuagagugcagcggcgugaucuugacucacuggaaccuccgccucccagguucaagcaauucugcugccucagccu

SEQ ID NO: 2244513 - RNA, 68 nt, Homo sapiens
ggcaggaguaagccuaagcaaaaggagaaauuuaaagauguaacuagggcauuggacuugcuuuugcc

SEQ ID NO: 2244514 - RNA, 60 nt, Homo sapiens
uacaugucauguaauuauaacuuuacuuugaacuaggguuuuuauuuauguggcauugua

SEQ ID NO: 2244515 - RNA, 63 nt, Homo sapiens
gaagaucuagacggugcacccagaacauccgcuacaguucaucccuugcaccauuugauuuuu

SEQ ID NO: 2244516 - RNA, 65 nt, Homo sapiens
uugaauggcacaagaguaaacuguuguauuacuucacacagcagagcuauucuugugcaauuuga

SEQ ID NO: 2244517 - RNA, 88 nt, Homo sapiens
aucccuucagguuuccaaggaaugcuaaguuuccucccuaucaugagagaugcaaagugaacuuaguguugggagauggaagcuggau

SEQ ID NO: 2244518 - RNA, 94 nt, Homo sapiens
gguaagugugguagauuuguuuuaauuguuuucauauguuggcucucucacauaguaugaaacucuaagauucacaucuguaaaugcacuuacc

SEQ ID NO: 2244519 - RNA, 55 nt, Homo sapiens
acuguuuacauuuguucacuggguucuugugacccuagcacacauguagaauagu

SEQ ID NO: 2244520 - RNA, 88 nt, Homo sapiens
cagaauuucuacccguugaggguuugccagcagagucccuggguuacuacuuuuaucugagcuggcuaaacucuuaguggucauucug

SEQ ID NO: 2244521 - RNA, 63 nt, Homo sapiens
cucacaguagcaaauguuagaaagaaugugaaguaacuagaauuuucuaccauugcuaguggg

SEQ ID NO: 2244522 - RNA, 79 nt, Homo sapiens
aggcuggaguguaguggcaugaucuuggcucauugcaaccucugccuccuggguucaagugauccucucgccucagccu

SEQ ID NO: 2244523 - RNA, 69 nt, Homo sapiens
ccuguaguuuaacuucaauggaaagaauucaagaaauggucucuacgcuguugcaguuauggcugcagg

SEQ ID NO: 2244524 - RNA, 90 nt, Homo sapiens
cucacggagaacaucuacuagaguagugcagaggggaaauguggccccacacaggauccccacuggggcacugucuaguggagcugugag

SEQ ID NO: 2244525 - RNA, 79 nt, Homo sapiens
gaagaacacaauuuuuuaucuauguuuucgcgaaggggaccagagcguuccuuccuuuguggggcgguggguaaucuuc

SEQ ID NO: 2244526 - RNA, 99 nt, Homo sapiens
gagguggggucuugcucuguugcucaggcuggagugcaguggugugauuauagcucauuuuagccuugagcucaugggcucaggcaguucuccuaccuc

SEQ ID NO: 2244527 - RNA, 80 nt, Homo sapiens
cuauaaucccaguguucuggaaggcugaguuaggagaaucacuugaggccaggauuucaagaacacccugggcaacauag

SEQ ID NO: 2244528 - RNA, 89 nt, Homo sapiens
cacaaaccuugcuggcuucaccaccugcugaucauagagcccuagggccuugagugaacauaggugguagccagguagugguuacagug

SEQ ID NO: 2244529 - RNA, 55 nt, Homo sapiens
augagauuguuugugugaaauaaacgcuuugugacuggcacacaggcgcucucau

SEQ ID NO: 2244530 - RNA, 82 nt, Homo sapiens
gugggagagaaaggcgaguacuaggagaugaaguugaagaauuaagcagagaccagaucaaguacugccuugcucuggccau

SEQ ID NO: 2244531 - RNA, 82 nt, Homo sapiens
aguuuuaggguacaugugcacaacgugcagguuuguuacauauguauaaaugugccauguugaugugcugcacccauuaacu

SEQ ID NO: 2244532 - RNA, 80 nt, Homo sapiens
ucugcauaauaggugcuugaggaacggaggcuguguguuucugcacgccagcccagugcauuuguguacucacauguaga

SEQ ID NO: 2244533 - RNA, 65 nt, Homo sapiens
uucuuaaugcaucuagaaaggugaauuuuucccagaaguuuacuuugcccagauccaucagagaa

SEQ ID NO: 2244534 - RNA, 77 nt, Homo sapiens
cuuuucuccccuuuacccugaggaaucuauuuugguuaacaggucaaaauuuuuuuccagguaguaggggaggaagg

SEQ ID NO: 2244535 - RNA, 94 nt, Homo sapiens
uguagacucagagcaauaggcaauaccauauauucuggguguguaguaagcuauaccaucuagauuuguguagguacccucuaugauguuugca

SEQ ID NO: 2244536 - RNA, 64 nt, Homo sapiens
aggauagagagaguuaguggcuuggcugcagccagauccaaggcacugauucuguacucagccu

SEQ ID NO: 2244537 - RNA, 78 nt, Homo sapiens
uaauuuaaugucaggcaccgauacaguuuuuugugguuguucagaaacgagaaaggugugugguucugaagugaauua

SEQ ID NO: 2244538 - RNA, 57 nt, Homo sapiens
cuugaacuagccauaaagaagccuuugcucuuagaagguucauguaauuaguucagg

SEQ ID NO: 2244539 - RNA, 88 nt, Homo sapiens
gaugaggaagccuucauccuucucaaggagccuucguaacugucagugggcaaguuacugagccuuucggaaccucaguuucuucauc

SEQ ID NO: 2244540 - RNA, 66 nt, Homo sapiens
ugcugagauguuuuguuaucaaaggauuguuaauauguggugccugauaauagacauucauaagua

SEQ ID NO: 2244541 - RNA, 72 nt, Homo sapiens
cugggugugguggugccugccuguagucccagcuacuugggaggcuaaggcagggcaaucauuugagcccag

SEQ ID NO: 2244542 - RNA, 86 nt, Homo sapiens
aauccucaaagcguggacguguguccccauggcuuguggaucagcuaagcucgggaucauuuccauaagucugcuuuucagggauu

SEQ ID NO: 2244543 - RNA, 55 nt, Homo sapiens
ugagaucaugucauuugcacuccagccugggcaacaagagcaaaacuuggucuca

SEQ ID NO: 2244544 - RNA, 81 nt, Homo sapiens
aacaguuaccauagaguuuuucauggauugaaagguuuguccuuugaaccauuugaagaaugaucaucuuucucugcuguu

SEQ ID NO: 2244545 - RNA, 90 nt, Homo sapiens
ugucuacagugcugaguaucuugaugaauuugaaauguucaguuaauuaaaacauuucaaaacagcuagauauuggaugucacugagaua

SEQ ID NO: 2244546 - RNA, 58 nt, Homo sapiens
aaagaacaagaagacacucuggcuuuuugaguuguuagagguuuugcacugguucuuu

SEQ ID NO: 2244547 - RNA, 95 nt, Homo sapiens
cgggccacaucgcaucuccaggugccagcugcgcccuccgcccugcccuuccccccggaggcggggccgcaccuggagaugcggauccggucccg

SEQ ID NO: 2244548 - RNA, 95 nt, Homo sapiens
ccccagagucgcuagaugccgaggggcugaucucugcgaagucaguggcgcccgcggcugaguuguaggggucaccuggcagggcggagcugggg

SEQ ID NO: 2244549 - RNA, 130 nt, Homo sapiens
accacauuuucuuuauccagucuagcauugaugggcauuuagguugauuccaugucuuugcuauugugaauagugcuggaauuaacauagaugugcauguguugauagaacaauuuauauuccuuugggu

SEQ ID NO: 2244550 - RNA, 80 nt, Homo sapiens
uuucagauuuuagauuuguggauuaaggaugcuuaaccuguaaguauaaugcacauucccaaaucugagaaaaucugaga

SEQ ID NO: 2244551 - RNA, 125 nt, Homo sapiens
gucacuuauuucacaaauaauagcuccauaacaaagugcugucauuguguggacauggagaagaggagcuccucuucuguguucugugcaaugagcacaaagcauugggugugaaucuuccuggc

SEQ ID NO: 2244552 - RNA, 70 nt, Homo sapiens
uccuuuauuguuaaagauguuaaugauccucugagccuucuggagucguaauuuuuuugccggugaagga

SEQ ID NO: 2244553 - RNA, 65 nt, Homo sapiens
ugguuggucucguauaaaucaaggguguuuauucacacauucaacgaguuuuugagcaccaacua

SEQ ID NO: 2244554 - RNA, 99 nt, Homo sapiens
gccuguugcaaguggagaggcagcccugagauaggacucugcuggcucagcccuccuccugagucuugaugccucucuccucauugcuuccacucaggc

SEQ ID NO: 2244555 - RNA, 70 nt, Homo sapiens
ucauuagauccauuaccuauaauaaccaucagauacuugguugauacauugaagguaauugguuuuauga

SEQ ID NO: 2244556 - RNA, 79 nt, Homo sapiens
cauucuaauuagguuaucucaaguguaauuuggccauuccugagcaugggcuagauuuugcguggugauuauaugaaug

SEQ ID NO: 2244557 - RNA, 78 nt, Homo sapiens
gggaucucuuaagagagccagcugguauauuuggaaaaauccuuaaaauggacccgcugugcuuucugcccaguuucc

SEQ ID NO: 2244558 - RNA, 58 nt, Homo sapiens
ugagcuagggucaugcuacugcacuccagccugggugacagaacaagauccugucuca

SEQ ID NO: 2244559 - RNA, 58 nt, Homo sapiens
uuggagcacuggggcacugacagccucugcuauggguugugagacuucagugcugcga

SEQ ID NO: 2244560 - RNA, 56 nt, Homo sapiens
uuagggaguaaucuaaaaaugguccuugggacuuuuucuaugauugauuccucuag

SEQ ID NO: 2244561 - RNA, 71 nt, Homo sapiens
gcuuuggcauguagauguaugggaaucaaaauacuugcccaacauuauauaucugguucaaaugucaaagc

SEQ ID NO: 2244562 - RNA, 62 nt, Homo sapiens
gcaucuccaggauuuucacacucagagaugaccacucuuaugaguagaacuccuggagaugu

SEQ ID NO: 2244563 - RNA, 57 nt, Homo sapiens
ggagacugugccaucaagaggcucugucacgagaugccaagaugagcacgcgucucc

SEQ ID NO: 2244564 - RNA, 92 nt, Homo sapiens
caaguaagccaaauuaugucauuuuuggauguuaaggaauccaauauuuugaaggauuaguuagaucagaaaaaggcauaauuuaucauuug

SEQ ID NO: 2244565 - RNA, 59 nt, Homo sapiens
aucagagugaauaaugacaaaacauuguagcuuggucguuuugcacucuucauucugau

SEQ ID NO: 2244566 - RNA, 57 nt, Homo sapiens
uucccaguuggggaaagcgacccauaguuuuggcuuugcuaccaccaacaugaggag

SEQ ID NO: 2244567 - RNA, 69 nt, Homo sapiens
gugauggaauggcacuuugaagauuagauuagaugggauguaauuuucaucuuggaugccuucugucau

SEQ ID NO: 2244568 - RNA, 58 nt, Homo sapiens
guuguggcuugugauuaagcaccuacaacauucuagaacuuaguuacaucccugcaac

SEQ ID NO: 2244569 - RNA, 81 nt, Homo sapiens
gauuuuucaucugguuuagcugguuauuauauaugacaaaaagagaucacaaugugauaguuggcuaaagcagucugaguc

SEQ ID NO: 2244570 - RNA, 57 nt, Homo sapiens
agaugaaugguggugaugguuacacaagcaugugaauguauuuauuaccauucaucu

SEQ ID NO: 2244571 - RNA, 127 nt, Homo sapiens
acauuaggaucccugaggaauuuuuaaaaauugcugaagucuagaaccuuaccuagagauucugaucugacuaagaugaggucuggauaguaguauauuuuuaugguuccccaagugguucugaugu

SEQ ID NO: 2244572 - RNA, 56 nt, Homo sapiens
ucuggagcugcgggugggaaggagccagacccugcccuugcuccccuuguucuaga

SEQ ID NO: 2244573 - RNA, 65 nt, Homo sapiens
guuggcauagucuuuuauaauuuuccucauccaauggugaugauuagagaaauacugcugcuaau

SEQ ID NO: 2244574 - RNA, 76 nt, Homo sapiens
guguguuaucaaguaguuauacguaaaggagaaaaagcuuucugaaugccuuucauagcaugccugauaaucauac

SEQ ID NO: 2244575 - RNA, 58 nt, Homo sapiens
caaggcagugugcacauaacacuguauugcaaguauuaguguaugugcaugugucuug

SEQ ID NO: 2244576 - RNA, 57 nt, Homo sapiens
ggugacuuucugucuuggugaucuguccagcgcugucaguggauuauuaaagucacc

SEQ ID NO: 2244577 - RNA, 88 nt, Homo sapiens
aucuccaagauguauuaagugcaaaaaugaaaguauagaaccacguuccugauaagcuaccauuuguauauaaagcaugugugggggu

SEQ ID NO: 2244578 - RNA, 74 nt, Homo sapiens
ugcugucuacagcacugccaagugacccauugggcuccaucuugaccaacugggcaucaagcggugcaaaagca

SEQ ID NO: 2244579 - RNA, 56 nt, Homo sapiens
ugcuuuaucucuuuguuucacaguuggggcaucuagcaacaguuggaggugaggua

SEQ ID NO: 2244580 - RNA, 103 nt, Homo sapiens
uugagagggagucucacucugucaucuaggcuggugugcaguggcaugaucucagcucacugcauccuccaccuccuggauucaagcgauucuccugccucag

SEQ ID NO: 2244581 - RNA, 66 nt, Homo sapiens
uacucuuuuugguguacaauucuauggauuugacaaaugcaugaagucguauguccaaaaauagua

SEQ ID NO: 2244582 - RNA, 63 nt, Homo sapiens
uucgguuugccaguauuuuauugaggauuuucgcauugauguucaucaggguauuggccugaa

SEQ ID NO: 2244583 - RNA, 85 nt, Homo sapiens
gauuuugaaagacuuucugcuguggauaaaaugcucucaaacagcaucauaugcuacagagaaaucuuucaugaaaggaagaguc

SEQ ID NO: 2244584 - RNA, 103 nt, Homo sapiens
ugguuuucuaauaggaaaauguacuuagguaguuuucccguauccaauccucaugacaggauugugagggagauauuacuuuauuuuacacuugagaaaacca

SEQ ID NO: 2244585 - RNA, 60 nt, Homo sapiens
ugugaauagugcugcaauaaacauacauguucaugugucuuuauaguagcaugauuuaua

SEQ ID NO: 2244586 - RNA, 100 nt, Homo sapiens
gcaugcacuguguguguggugugcauagugugugcggggcgugcagugugugugcgguguguguggcaugcacuguguguguggugugcauagugugugc

SEQ ID NO: 2244587 - RNA, 64 nt, Homo sapiens
uuacauucauguggugauaugguuuggaucuguguccccagcuaaaucucauguugaauuguga

SEQ ID NO: 2244588 - RNA, 74 nt, Homo sapiens
auguuugagaugauggauaugcuaauggccauguguaauggccuauuugacauuauauacacguaucuaaacau

SEQ ID NO: 2244589 - RNA, 122 nt, Homo sapiens
uguuuccaauuucucauuauuauuaccaaugucuagcacauuuaucuuuauacauguacaacuguaucuguaggagaguuggaauggcugcgucgaaggguaugguauaggaauuuuaaaca

SEQ ID NO: 2244590 - RNA, 60 nt, Homo sapiens
gaaugagccagagaggcagacauuaucuugcagaaaaagucaguucuugugguugcauuc

SEQ ID NO: 2244591 - RNA, 56 nt, Homo sapiens
auguguacugagcacuuacugugucucaggccuccuccuaagugcuuuaaacacau

SEQ ID NO: 2244592 - RNA, 100 nt, Homo sapiens
gucauugaauacagguaucccuugcuaucugaaucuacuugguuucugagucagggagcuugaguucagguagaaagggauaccuguacuucucuguggc

SEQ ID NO: 2244593 - RNA, 69 nt, Homo sapiens
gagccaggugaagauuuacaauagguaguuggacacuaagacauggccuuugagaucuguaucugguuu

SEQ ID NO: 2244594 - RNA, 78 nt, Homo sapiens
agccuuuauaagugagcuaagugccaauauuaauucaccaaagugagaugagcaugugcuuaguaaacgaugggggcu

SEQ ID NO: 2244595 - RNA, 55 nt, Homo sapiens
guugucacauuaguagcuuacaacugucuaucaugaguauguuuaaugugacaau

SEQ ID NO: 2244596 - RNA, 56 nt, Homo sapiens
uugaaagagaccaucucugagaugaucccauuuuccagagaucaucucuguuuuaa

SEQ ID NO: 2244597 - RNA, 63 nt, Homo sapiens
gcuaagguucuugcuugcaugacuguccacaugucgggcucauguggguagggaaucaauagc

SEQ ID NO: 2244598 - RNA, 102 nt, Homo sapiens
aauauccacuguaagcucugucugaacugagacuagacuuguuccuucauggguggaggaacaaguuuagacucaguugagacauagcuuacaguggauauu

SEQ ID NO: 2244599 - RNA, 55 nt, Homo sapiens
uucugugcugaaucaaagacugcuauuugugcucauuugcgguuuaguaacagaa

SEQ ID NO: 2244600 - RNA, 72 nt, Homo sapiens
caugauuaaagauguucucauuucauagguucuuauaucugaauuguaugagagugaaagcauuucugcaug

SEQ ID NO: 2244601 - RNA, 98 nt, Homo sapiens
guuucugauucagcagaccaagguugagguuugcauuucuaacauuuguauuucuguuagaacauuccaggugauguuggagcugcugauucagagac

SEQ ID NO: 2244602 - RNA, 55 nt, Homo sapiens
ggaggcagucugucccuuagcagagcucaaguacugugcugggagaucugucuuc

SEQ ID NO: 2244603 - RNA, 129 nt, Homo sapiens
auccacccaccucggccucccaaagugcuggaauuacaggguugagcuagccaaaaaagucuucacuugguuaagcacaguggcucacaccuguaaucucagaacuuugggaggacaaggugggaggau

SEQ ID NO: 2244604 - RNA, 81 nt, Homo sapiens
uaauuuagggguauuauguaaaucugacaggaguuuuucccuuuauuuuccuguaguuuaacuuuaauugcuccaagauua

SEQ ID NO: 2244605 - RNA, 66 nt, Homo sapiens
cacagaauucauuggauuaccuauugggacaaaucaauucuagccauguaaaccagugagucugug

SEQ ID NO: 2244606 - RNA, 71 nt, Homo sapiens
ucauguccucaguggauuggauggugcccacccacuuuggggagggccauguacuuuacugaguccacuga

SEQ ID NO: 2244607 - RNA, 74 nt, Homo sapiens
ugauacugucuaccuggaguuagcacagaugccauggauugagaucuguguuuagacccaggguaggcccauca

SEQ ID NO: 2244608 - RNA, 71 nt, Homo sapiens
augagugaaugaauguuuauccuuagauuuuagaaauuaaaggagaggaacauacauuuuaaugcacuuau

SEQ ID NO: 2244609 - RNA, 75 nt, Homo sapiens
acuauuaacaucuugcauuagugugguacauuuguucaaacagaugaacugauauugauacauuguuaauuaagu

SEQ ID NO: 2244610 - RNA, 61 nt, Homo sapiens
guauguuucugcccaucucuggaaaaacccagguaggcacuggugggaagagagaacaugc

SEQ ID NO: 2244611 - RNA, 55 nt, Homo sapiens
uugagauggagucuugcgcuguugcccaggcuguugugcaguggcacuaucucag

SEQ ID NO: 2244612 - RNA, 96 nt, Homo sapiens
augccuauugugugaauauggauuauuacuaggaccuaugugaaauuaaguauuauucuugguugaaaauucauaauauguccaugcaucuggcau

SEQ ID NO: 2244613 - RNA, 85 nt, Homo sapiens
caugaaaaugggcuuuuccuguuucauagaaaacugaacaauuuauuucagucauugauggaguaggucaguguuuaucuucaug

SEQ ID NO: 2244614 - RNA, 65 nt, Homo sapiens
aagcaauuguuugauuucauggcugccugagaucauggauaacagccaggucaaacaacaggcuu

SEQ ID NO: 2244615 - RNA, 81 nt, Homo sapiens
ucaaugugaauggccugggaugauguaaauaggcuauugguuuucugguagcauguauuuacacauuuaccaacucauuga

SEQ ID NO: 2244616 - RNA, 99 nt, Homo sapiens
aggaauuuuuaaaacauuaguuacagaauguacagagguuuaugguuuauuucccagauagcuuguguuuuucuaaguaucugauuuuuauuuauuucu

SEQ ID NO: 2244617 - RNA, 61 nt, Homo sapiens
cucuaauuccagcacuuugggugaccgaugagagaggaucacuagaguccuggaguuugag

SEQ ID NO: 2244618 - RNA, 79 nt, Homo sapiens
guuugugguuaaagccuuucauuugaccuugucacuauaguuuccaugacauuuuuugguaggcuucuaacauacaaau

SEQ ID NO: 2244619 - RNA, 55 nt, Homo sapiens
gugcccauguguucucaucauuuagcucccacuuauaagugagaacaugggguau

SEQ ID NO: 2244620 - RNA, 86 nt, Homo sapiens
uuagcgcuuggcugccagcuuuuagugggcuuauuacuuccuuaaagagaaauagagagcuguuugaaagcaggcacaggaacuag

SEQ ID NO: 2244621 - RNA, 86 nt, Homo sapiens
cuaggaaggugucuacugcugucagugccaaguaguauccuuaagaacuauauggucuacuugacagacaugucugguaccccuag

SEQ ID NO: 2244622 - RNA, 69 nt, Homo sapiens
cauguguccucaaugauuuugguuuuaauaugauuauaugaagcuaugacuauugagcauaaacacaug

SEQ ID NO: 2244623 - RNA, 96 nt, Homo sapiens
ccaugacguacaucuuaaggaucauaguaaacauugauguggaagccauuuguuuuguaaucugguguggcugugauccucagaucugaaauaugg

SEQ ID NO: 2244624 - RNA, 56 nt, Homo sapiens
gccuuagcagaguccuuaccagggucuaggggcuggauacaggacugagcugaggu

SEQ ID NO: 2244625 - RNA, 67 nt, Homo sapiens
ugagagauaauuugaaucaugggggcgguuucccccauacuguucucgugguaaugaauuagucuca

SEQ ID NO: 2244626 - RNA, 111 nt, Homo sapiens
acccuaaugcauauuauggacuguaguuaauaaucaugucaguauugguucaucacauauaacacacuaaugcaagauguuaauuauaggggaaauugugcaugugagggu

SEQ ID NO: 2244627 - RNA, 59 nt, Homo sapiens
cuuaguguuacuaugugccaagcacucuugugagugcuuuguacagcuugacuacuggg

SEQ ID NO: 2244628 - RNA, 67 nt, Homo sapiens
uuucuguuucauauuuauaucugcaaucuauuuggaauuaguuuugguauguagugugaaguaggga

SEQ ID NO: 2244629 - RNA, 76 nt, Homo sapiens
ggcauuuugauagauguacaguagcauuuuacacauuuuagugacaacuaaugacacugagcaucuuucauauguc

SEQ ID NO: 2244630 - RNA, 57 nt, Homo sapiens
gucuauuuggggauaacuaggcuucccguaucuggauaucuaaaucucuugauagac

SEQ ID NO: 2244631 - RNA, 83 nt, Homo sapiens
ggugagaaacugaauaucccgcuaugcaaaguacaaacaagcucucugugaaaaugcuuuguuauauggggauucuucucacu

SEQ ID NO: 2244632 - RNA, 86 nt, Homo sapiens
gggcuggauugaaugguacaguuuagugcuuugagaaaacuucauaugguuuuccauagagauuguacuaauucaccuucccaccc

SEQ ID NO: 2244633 - RNA, 105 nt, Homo sapiens
gugcauuaugugggaguauguauuugcuacuuggauguacauguguaccucaagcuguguugugugggcauauguguaucggugcaaaugcacuuauagauguau

SEQ ID NO: 2244634 - RNA, 77 nt, Homo sapiens
ugaaucauacaguaguccucacuugugcaaacccuccucauucaguucauacaagcuaaguugcugcuugugauuua

SEQ ID NO: 2244635 - RNA, 66 nt, Homo sapiens
gcugaggagugugccgcuacccccacuaauuuuuuaaggcaaagcguaguggcaugcaccuguagc

SEQ ID NO: 2244636 - RNA, 79 nt, Homo sapiens
ggaagcugcgugaccagaugggcagggguguggccagcugaguggcugugacacacuucuugcacaucgucugucuucc

SEQ ID NO: 2244637 - RNA, 68 nt, Homo sapiens
ggguacaugugcacaacaugcagguuuguuacauauguauaccugugccauguuggugugcugcaccc

SEQ ID NO: 2244638 - RNA, 71 nt, Homo sapiens
uaguguuguucuaugcagagaauaccugacgauacuuguuuucugagguaggugcauggauacacaaacug

SEQ ID NO: 2244639 - RNA, 82 nt, Homo sapiens
uuucuagcauacagguaaucacacuguuauuuuaguuaaaguuagcuuaagccagagguugugugaucaguaaugcuagaaa

SEQ ID NO: 2244640 - RNA, 83 nt, Homo sapiens
ucuauuugugaaaauucaucaaaugguuuguauauaugaaaaaaaugaaauauaccugcaggauguaauauuuugcaaguaga

SEQ ID NO: 2244641 - RNA, 71 nt, Homo sapiens
gaggaaaaaaaugguuuccuggccagggcuagggcauuacugcuuugugccacuccaggaggcuguuccuc

SEQ ID NO: 2244642 - RNA, 55 nt, Homo sapiens
gaagauggaggcugcagugagcugagauugugccacugcacuccagucccgucuc

SEQ ID NO: 2244643 - RNA, 69 nt, Homo sapiens
ugugugucuugaccaggaucggauauaaauucuauuauuggaaguuuccaggacccugguagacacaca

SEQ ID NO: 2244644 - RNA, 55 nt, Homo sapiens
cagcagguuuuuaucaguuaagcugcuucuaggcaacugguagaaaugucugcug

SEQ ID NO: 2244645 - RNA, 76 nt, Homo sapiens
uugugaaagcucaggaaucaagauauucuuccuucgaaauacuuagauaugucuuaguuaccuugggcugccauaa

SEQ ID NO: 2244646 - RNA, 103 nt, Homo sapiens
cuccucagcccuuggguggucgaugggacugggcgcccuggagcaggggguggcgcuugucagggaggcucggccgcacaggagcccauggagggggugggag

SEQ ID NO: 2244647 - RNA, 129 nt, Homo sapiens
ccugauuuauuuauucaacaaguauguaccuucccaggcauuagucaaguguacugugaaugaaaaagacaaaaaucccuauuauccagagcuuacuuuuuagcuaggggagguagauaauaaaugagg

SEQ ID NO: 2244648 - RNA, 60 nt, Homo sapiens
accuaaaaggcuaguuuccaacuagcuccugaaggcuaacuggaaauuaaccuuucaggu

SEQ ID NO: 2244649 - RNA, 78 nt, Homo sapiens
guuuuaaaauuggcauugaguuucaaaucauacuguauaaacugccaaugguaugacacucauuguuuauuuuaaagc

SEQ ID NO: 2244650 - RNA, 80 nt, Homo sapiens
gaagauuuacugcugacaaucagguugcuaaguauaauauuauucauuauaauaugugacaagaauuugagugucucuuc

SEQ ID NO: 2244651 - RNA, 73 nt, Homo sapiens
cucucaguccugcgcgccucugugggccaagacacacccacagaaaugcagcaugaggcggcaggccugaggg

SEQ ID NO: 2244652 - RNA, 75 nt, Homo sapiens
uuagacaaauuucacagugaacuuugaggacucuagauacgaguguuucauguuuuucugugaggcauugauuga

SEQ ID NO: 2244653 - RNA, 57 nt, Homo sapiens
ucagguagucaacgggucuuggagagggaugaccuucuccaauaccauggcaccugg

SEQ ID NO: 2244654 - RNA, 66 nt, Homo sapiens
uauggcagcugacacuuccgucuucagggcagggcguacgaagagggggccuguuaguugcacaug

SEQ ID NO: 2244655 - RNA, 82 nt, Homo sapiens
aaaaaauauggaugccuggguccuaucccacaccaauuaaaucaggaacucuugggaugaagcccuaggguugguauuuuuu

SEQ ID NO: 2244656 - RNA, 63 nt, Homo sapiens
ggaaugacauuccacagccguagaggagccaggcuagccucagcccuguaggagugacguucc

SEQ ID NO: 2244657 - RNA, 78 nt, Homo sapiens
guggauuuuggguuugguucuguuuaugugcuggauuacauuuauugauuugcauauguugaaccaggcuugcauccc

SEQ ID NO: 2244658 - RNA, 71 nt, Homo sapiens
agugugagucucucaaaacuguauauguugaugcccuaacuuccaauguaacaguauuuggagauguuacu

SEQ ID NO: 2244659 - RNA, 56 nt, Homo sapiens
uuuuucacuuaaguuaggcucagaaacaauugaccaccuaauugguugguggaaga

SEQ ID NO: 2244660 - RNA, 73 nt, Homo sapiens
ggaguuuaguugagcaaugaacgauucagggaucggauaucccccagaaucacagcugauucaaagagacucc

SEQ ID NO: 2244661 - RNA, 55 nt, Homo sapiens
gcauuugcugaagaguguauuacuuccaauuaugugaucaguuuggaguaagugc

SEQ ID NO: 2244662 - RNA, 81 nt, Homo sapiens
uaugccagauugauuuuggucuuuuguaaguuaucucaggauuuguaggaaguuacagguagaccacaguuauaagguaug

SEQ ID NO: 2244663 - RNA, 67 nt, Homo sapiens
uaaauauuagguuggugcaaaaguaauugcaaaaacuguaauuacuuuugcaccaaccuaauggaua

SEQ ID NO: 2244664 - RNA, 63 nt, Homo sapiens
gagauguacuguuggucuuucauuuucuucaguuugaaaaugauaugccuaggaguauauuuu

SEQ ID NO: 2244665 - RNA, 100 nt, Homo sapiens
ggaugcagucagugagcauuucugguuaauuucuaagagcucucagaagaagaaggcucuuaaaauuguaucagcuuuagguaucacaaaaccuggaucc

SEQ ID NO: 2244666 - RNA, 85 nt, Homo sapiens
gccuggggcucuuggcuagucaaaccuccccggggaccugagacgaccugacccugguggguggcaagccgagaccucuucaggc

SEQ ID NO: 2244667 - RNA, 87 nt, Homo sapiens
guaguaaugguuguauaauauuuugggugugcuuaaugccacugaauuacacacuuaagacacuuaaaauguuacauuuuauucuau

SEQ ID NO: 2244668 - RNA, 89 nt, Homo sapiens
ggcugggucaaacgguauuucuaguucuagauccuugaggaaucaccacacugucuuccacaaugguugaacuaguuuacagacccacc

SEQ ID NO: 2244669 - RNA, 66 nt, Homo sapiens
auugugaauagugcugcaauaaacauacgugugcgcauguguccuuauagcagcauguuuuauaau

SEQ ID NO: 2244670 - RNA, 88 nt, Homo sapiens
gagguugcaacuagaaggagagacaggagcaggaaaugcaaauccacauuuaucuggcuccaaagucuauuuuuucuaguaguaccuc

SEQ ID NO: 2244671 - RNA, 62 nt, Homo sapiens
uguacccaucaucccuggggguguccuguuuucccuaagacagugaggggugcauggguaca

SEQ ID NO: 2244672 - RNA, 67 nt, Homo sapiens
gaauguucaguagucaaaagauaagggucauagggguuuugaugucuugucaaucuauuuaacauuc

SEQ ID NO: 2244673 - RNA, 91 nt, Homo sapiens
ucccuagauuaguugauuaaguauuaugaguccuuguuuucauaccuguaaaauagggaucauaauaccaaucucauggaauuacugggga

SEQ ID NO: 2244674 - RNA, 129 nt, Homo sapiens
uccugaccucaggucaucugcccaccucggccucccaaagugcugggauuacaggugugagucacugcgccuggccaauaauccuagcacuuuggaagaccuaggcaggaggaucacuugaggccagga

SEQ ID NO: 2244675 - RNA, 129 nt, Homo sapiens
gccucccaaagugcugggauuauaggcaugagccaccaugacuggcuaugaaacaauuuuuaauacagaaauugugcuuguaggccaggcacaguagcucacaccuguaaucccaguacuuugggaggc

SEQ ID NO: 2244676 - RNA, 67 nt, Homo sapiens
cuaaaguaaguaucacuggacagaaauaaagguguuggcaagaccaugcuccuuccaguggcuuuag

SEQ ID NO: 2244677 - RNA, 74 nt, Homo sapiens
uuucauagauggcucuuauuauuuugagguaugcuccuuugaugccuagucuauugagagucuuuauuaugaaa

SEQ ID NO: 2244678 - RNA, 64 nt, Homo sapiens
uagggcuaucaacuuuccucuuagcaccaccuuugcuguauuccagagguuuugauagguucug

SEQ ID NO: 2244679 - RNA, 72 nt, Homo sapiens
gcaugagcccuauagagcugccuugccuaugcaagaggcuguccuagccugaggcaaggcaauggggugugu

SEQ ID NO: 2244680 - RNA, 101 nt, Homo sapiens
gagcaccccgggaaaggauaaggcuguucauuuagcacagugccugcaacauggugagcacugggcagaugaccaccguuaucuguguuaaucugguguuu

SEQ ID NO: 2244681 - RNA, 75 nt, Homo sapiens
ugucuuuauuagcagugugagcacagacuaauacaguaaauuggugcugguuagugaggcacugcuguaaagaca

SEQ ID NO: 2244682 - RNA, 61 nt, Homo sapiens
acauguauguaugcacauauguacugcccuauuucaaagaaauagaugugcacauagaugu

SEQ ID NO: 2244683 - RNA, 65 nt, Homo sapiens
aaaaccacuuccuugcuauugggcuguugcaaaagauaauagauaauaguuucagaaguuguuuu

SEQ ID NO: 2244684 - RNA, 76 nt, Homo sapiens
ugggucuguaagagugguuacaccaagggcacuccuguuaucuauuauuguugauguugccacuguuauuaaccua

SEQ ID NO: 2244685 - RNA, 63 nt, Homo sapiens
aucagaaucucuagugggaccaagagaucuauauuuuaaacaaguacccuaggugauucugau

SEQ ID NO: 2244686 - RNA, 125 nt, Homo sapiens
uauagcacucaaaacugucaagcuguaacagcaucacugugauuucuacugugcugagcagcagugugaagcaaggagagcaucacauauggucgcuguuguagcuacucagcuuagguguugua

SEQ ID NO: 2244687 - RNA, 69 nt, Homo sapiens
gugcuuuaacucaagagguggagguugcagugagcugaggucgugccauugcacuccagccugagcgac

SEQ ID NO: 2244688 - RNA, 56 nt, Homo sapiens
gagggcguguuaucaggagagcaaagaccccucuuccucuuugaggcaucgcccuc

SEQ ID NO: 2244689 - RNA, 89 nt, Homo sapiens
ccauguguacuggguguuuagcugcacuuacaagugagaacacgcaguauuugguuuucuguuccugcauuaauucacucaggucgugg

SEQ ID NO: 2244690 - RNA, 80 nt, Homo sapiens
uucccacucuuggaucucgaagacuaagcaucucugaucaagcaucucugaucaagcaucuuggucuacgauccugggag

SEQ ID NO: 2244691 - RNA, 64 nt, Homo sapiens
cuugacacacagaguggggauuagcuggauucgcuggauuuagcaauucauuuugugucucagg

SEQ ID NO: 2244692 - RNA, 95 nt, Homo sapiens
cuaugcaucaaggaucagucugaacaagcaaggccaugccgucaggaaagauagccugcgcuugcauuguuccgaauguguccucucuuggauag

SEQ ID NO: 2244693 - RNA, 64 nt, Homo sapiens
cagccuguccucaaaaugaaaguucaguaaguauuugaagacucaguuugagggacaccugcug

SEQ ID NO: 2244694 - RNA, 65 nt, Homo sapiens
aguucgcacaggcacagacacugggaugaugagggguaccaucccacugucuucucgugcucgcu

SEQ ID NO: 2244695 - RNA, 56 nt, Homo sapiens
auuuggaagguuuacaaagagagauuacuacuuuucucagugcagauuguccaagu

SEQ ID NO: 2244696 - RNA, 85 nt, Homo sapiens
uugcuagaauauagaaauguagaauauagaaauauagaauugaauuuuguauguugauguuauauucugcaaccuuguuaaacaa

SEQ ID NO: 2244697 - RNA, 76 nt, Homo sapiens
cauguaggguaaguuccugacauugccauggcauuuguaaacugucauggugcuagcgggaaugucucuuagcaug

SEQ ID NO: 2244698 - RNA, 65 nt, Homo sapiens
aaaauaauggucuuuuuguuaugagagaggcuuagcuuuucucuuucaaaggaaaccaucauuuu

SEQ ID NO: 2244699 - RNA, 64 nt, Homo sapiens
uucaguuugccaguauuuuauugaggauuuuugcauugauguucaucaggaauauuggccugaa

SEQ ID NO: 2244700 - RNA, 69 nt, Homo sapiens
ucccaaaaaggacaaaguauuuucaaauguaggaaaauugcaccugucugcuuguguucucauugugga

SEQ ID NO: 2244701 - RNA, 56 nt, Homo sapiens
uugugguuuuagcacuguggaugauggcuguucccauccauuagcucaaacaacaa

SEQ ID NO: 2244702 - RNA, 78 nt, Homo sapiens
gagacugagccagauguuccccuggaggccucuugggagccagcaagauggccuuucuggcacauuuccucucuucuc

SEQ ID NO: 2244703 - RNA, 68 nt, Homo sapiens
gggaaguugacagaugggggcauuuggaggaugaggaggaucucaggaugacccuggguguccuuucc

SEQ ID NO: 2244704 - RNA, 80 nt, Homo sapiens
gccucugcuggccggcuguacccugaggugcccucucacuuccuccuucagguucucagcggacaggccggccaggaggu

SEQ ID NO: 2244705 - RNA, 71 nt, Homo sapiens
uuucucaaucagguuuugucucucuuuuuugcauuaaaagcugagagaggagcuaaaacugcccugagaag

SEQ ID NO: 2244706 - RNA, 58 nt, Homo sapiens
gguugguggcaguaacgguggaucugaggagagccgagagcaucguuguguuauagcc

SEQ ID NO: 2244707 - RNA, 112 nt, Homo sapiens
guggggaaauaguauugauauucaccugggaaugaaauuacauagcuucugacugaaaccuugguguugagggugaauuaucucccagagguaguuaauguuagguuccuac

SEQ ID NO: 2244708 - RNA, 89 nt, Homo sapiens
ggagaaucgcuugaacccgggagguggagguugcggugagcugagauugcgccacugcacuccagccucggcaauaagagcgaaacucc

SEQ ID NO: 2244709 - RNA, 79 nt, Homo sapiens
guugaacuuuucucccauugcaaacaacagaagcuaaguuguuucuuagcuucuaauuuaagcaaacuggggauuuaau

SEQ ID NO: 2244710 - RNA, 57 nt, Homo sapiens
uugaagguaggaugugcuaucaaacuacagaaaguguagccagucaacggccuucag

SEQ ID NO: 2244711 - RNA, 63 nt, Homo sapiens
uugauuuaaauggacagauaaccaucuuuaccacagaagguuauuaguugauauuaaguucaa

SEQ ID NO: 2244712 - RNA, 70 nt, Homo sapiens
cauuaggcuuguuuuacuaacugguaucuuuauauuggaguuugcuaguugauaaagcauugucauaaug

SEQ ID NO: 2244713 - RNA, 60 nt, Homo sapiens
ggauuuucagugucuucaucuacaaaaugaaagauuuagagugaaugacaucuaaagucc

SEQ ID NO: 2244714 - RNA, 84 nt, Homo sapiens
gugacugagcggugagugaaugugaaggcuagggcaguacuguauacuacuguagacuuuauauguacuguaugcuuaggcuac

SEQ ID NO: 2244715 - RNA, 78 nt, Homo sapiens
aaauaucuaguauagugguuuccaaugagagcaggacugauuccuagugggguauuuuggaaaccucugcagguguuu

SEQ ID NO: 2244716 - RNA, 114 nt, Homo sapiens
cggccucccgaaguguugggauuacaggugugaacuaggcugacacuauuaaauuauacuuuuggccgggugcaguguggcucacgccuguaaucccagcacuuugggaggcug

SEQ ID NO: 2244717 - RNA, 87 nt, Homo sapiens
ugcugauuuuuguggcuggauguuucaauacaaauaaagaugucuauguguggucauauuggauugaauauucaugucacugcagua

SEQ ID NO: 2244718 - RNA, 70 nt, Homo sapiens
agaaucuauauacuguuucucaccuugguggcuccaaucuacauuuccaccaacaguguguaaggguucu

SEQ ID NO: 2244719 - RNA, 84 nt, Homo sapiens
ugcaaaucccucucuccuacuuguaaagacaauuuaaaguagaugcucuuggauggucuuuauauaguaucggaauuauuugca

SEQ ID NO: 2244720 - RNA, 64 nt, Homo sapiens
guaacaccaguuauaucaguucccauaauugaaaacuguggcaaaauauaauugcugguguuac

SEQ ID NO: 2244721 - RNA, 59 nt, Homo sapiens
ccgugguaacucagaguacacagcucuugguauguggguuagguacucagugaccaugg

SEQ ID NO: 2244722 - RNA, 74 nt, Homo sapiens
uugugcccagggaauauaaaacuuuugacaggcagccuaucugccuuccuaguaguuguguuuccauuccacaa

SEQ ID NO: 2244723 - RNA, 70 nt, Homo sapiens
uccucuugcuauuuguuuucaaugugucauucaguggugggcugaaauguuaaacaaguggcucugaggg

SEQ ID NO: 2244724 - RNA, 84 nt, Homo sapiens
guuaguguacaaaaugauagauaaauauuugcuguugcuaaaagcaucuuagugauaaccuuuguacuaugguuuuucacuaac

SEQ ID NO: 2244725 - RNA, 57 nt, Homo sapiens
ugugaacagcagcugggcuuugcuucaauaugcugaaggcaugugcugcaguucaca

SEQ ID NO: 2244726 - RNA, 75 nt, Homo sapiens
uaguguucugagaaccaggcugggcguuucaagguucaguauguucacuuggaauuaauccuccugguuucacua

SEQ ID NO: 2244727 - RNA, 67 nt, Homo sapiens
gauuuuuugccaguauuuuguugaggauuuuugcaucaauguucaucagggauacuggccugaaauu

SEQ ID NO: 2244728 - RNA, 78 nt, Homo sapiens
cuugccugggccugguuccucuggugauugucauggaagugacacagcaagauggaaccauuccaacaaaccagcaag

SEQ ID NO: 2244729 - RNA, 129 nt, Homo sapiens
auguaugugugugaaggggguguauguguaugaguauguauaugagugugucugugaguacaaacacccacuaacagacacacucacauauauacucucauacacauauacccucucacacacauauau

SEQ ID NO: 2244730 - RNA, 64 nt, Homo sapiens
ugcucagaucagcagagauggugcuuuuaaaauauuuaguuccuuagcucucugguuuaaagca

SEQ ID NO: 2244731 - RNA, 127 nt, Homo sapiens
gggaugugaacauagguuuucaagccaauuagauaaauauguagaacaauugcuggauccgaauuuuauaagauauauguucagacuagcaauugucuuccaaaguggcuguaacauuuuacauucc

SEQ ID NO: 2244732 - RNA, 101 nt, Homo sapiens
ugagguggagucucgcuguguccccgaggcuggagugcaguggcgcgaucuuggcucacugcaagcuccgccucccggguucacgccauucuccugccuca

SEQ ID NO: 2244733 - RNA, 98 nt, Homo sapiens
uguaaaugguugcauagcauauauuguagagucucugggccauacagucacuaaugcaaccauuccacucugcaauagugcuaaggcaaccauagaca

SEQ ID NO: 2244734 - RNA, 79 nt, Homo sapiens
aaaguucaagaguucaguuuugaaauguuaauuccuuuuugggaaauugacauuuguagaauaaugguuuaggaauuuu

SEQ ID NO: 2244735 - RNA, 77 nt, Homo sapiens
ggcaguguuggggccggaggcugcugugucugcccaagcuccucucagaguccaguccccaggccuccagcgcuguc

SEQ ID NO: 2244736 - RNA, 73 nt, Homo sapiens
gaugagaauugcauugaauuuguagcuugcuuuuggcaguauggucauuuucacaaugucgauucuacccauc

SEQ ID NO: 2244737 - RNA, 82 nt, Homo sapiens
ccaucugcuuuguuaaaacacagccacacucauucacuuaugucuugucuguggcuguauuuuaacuggaagggcggaaugg

SEQ ID NO: 2244738 - RNA, 89 nt, Homo sapiens
ggagaaucacuugaacccgggaggcagagguugcagugagccaagauagcgccauugcacuccagccccggggacaagagugaaacucc

SEQ ID NO: 2244739 - RNA, 88 nt, Homo sapiens
aaggugggucaauuuugagguguagucaugccaagaucuuccugugggaucaggcuauggcuagaucucaacuuuucacacucauuuu

SEQ ID NO: 2244740 - RNA, 79 nt, Homo sapiens
cagcauguugaaaccugaagaaaauauuugcugagaacauucaguucgauaauuuuccucaauucagugguuuaggcug

SEQ ID NO: 2244741 - RNA, 65 nt, Homo sapiens
agauacacauugugagaaaugcguccuuaggugauuucaucaugcaaacaucauagaguguacuu

SEQ ID NO: 2244742 - RNA, 57 nt, Homo sapiens
aucuuuaguggcuguuuucagagagaagcaccuucaccaaacagccuagcuaaggau

SEQ ID NO: 2244743 - RNA, 63 nt, Homo sapiens
gcccaggagauggaggcugcagugacccaugaucacaccacuauacuguacuccagucugggc

SEQ ID NO: 2244744 - RNA, 95 nt, Homo sapiens
aaauaucccuuuuuauggccaauccucagaagucuugcagagucacuaaggccagcucggauucgaggguaggggucauauagaggggaauguuu

SEQ ID NO: 2244745 - RNA, 55 nt, Homo sapiens
uuugagaucuuuagaaucaggcauuuggaccaguugaccuguaaaguaucucaga

SEQ ID NO: 2244746 - RNA, 62 nt, Homo sapiens
gguauuuuguuagggugugguauuuguuacagcacagcauauugaacccuacagacuguacc

SEQ ID NO: 2244747 - RNA, 64 nt, Homo sapiens
guaaucucagcuacucgggaggcugaggcaggagaauugcuugaaccugggaggcagagguugc

SEQ ID NO: 2244748 - RNA, 69 nt, Homo sapiens
gcuacuuugagaaauauuuagguauuuucccccugguaguaccauuaggauauuucugcuggagauggc

SEQ ID NO: 2244749 - RNA, 57 nt, Homo sapiens
cuggucaugggggcacccucuggaggggagcuuuacccaggggcaccccgucgccag

SEQ ID NO: 2244750 - RNA, 63 nt, Homo sapiens
uguagugcuaagguacuuuggagaaaacugacauuuuuauaaugucagaaguaucgaacuaca

SEQ ID NO: 2244751 - RNA, 96 nt, Homo sapiens
aagacccacaguggagagaguuagagauaggcuguguggccguggggcucagcggagggaagucgccaggcugcauggccacucuguuugggucuu

SEQ ID NO: 2244752 - RNA, 60 nt, Homo sapiens
guuuucaugaacgccuccuggcucuguuuagaggguuccgugagagaguucauagaaagc

SEQ ID NO: 2244753 - RNA, 78 nt, Homo sapiens
guuuggaaacuuuguagccacagguggugaggaaauuuaacagcgcuuguauggcuugauggcacaagguuucugaau

SEQ ID NO: 2244754 - RNA, 84 nt, Homo sapiens
ggauguacagaaacacucucucauuacuuguuuguggacauguaaauuguuacaacauauacagagagcagugugacaauaucc

SEQ ID NO: 2244755 - RNA, 56 nt, Homo sapiens
ugaaagguccacuguuacucugauaggcuucccuucacaguuggccuggccuuuua

SEQ ID NO: 2244756 - RNA, 75 nt, Homo sapiens
ugauguugaguaauguugaucuuugauauacauaaucucauggauaaacauuacucuagaaacuaaaagacauca

SEQ ID NO: 2244757 - RNA, 69 nt, Homo sapiens
cuugaacccaggagacggagguugcggugagccgagauugcaccguugcacuccagccugggcaacaag

SEQ ID NO: 2244758 - RNA, 83 nt, Homo sapiens
uuggugaaaugagcaaaguggcauugaggaaaaaaauauauauauauacuuuucauucucacugcacugaugccaucaacuaa

SEQ ID NO: 2244759 - RNA, 72 nt, Homo sapiens
uggagaagugauuugagggugaaaauaggguaagcguauuuacucuuuagcuccuuaaggaaugcuucuuca

SEQ ID NO: 2244760 - RNA, 62 nt, Homo sapiens
caguggagaguugaggaagaugcaugggaauuggucaggaacucccucaaacuuuuccacug

SEQ ID NO: 2244761 - RNA, 70 nt, Homo sapiens
cccagucucagguauuucuuuuagcugugugagaaugaacuaauacaaaaaauugauacugacgaguggg

SEQ ID NO: 2244762 - RNA, 124 nt, Homo sapiens
cucaguggggcagcaaguagcucaggacaccaggcaacuuuuaagcucucauaaugcugugcuggaguuggagcagaagcuugugcuguaugaagggccuugguugggguuucuggaccaugag

SEQ ID NO: 2244763 - RNA, 116 nt, Homo sapiens
cccacccccaaccccugaguaaagugcucugguaucuuggagagagaagugagacaaguuccuucucccucucaggugcaucaacacagcagaauauucuuaguuuguaaaguggg

SEQ ID NO: 2244764 - RNA, 73 nt, Homo sapiens
cagagcaccugcagguaggggcagcuuugggaacagcuucugcagacuaaaacgucccugccugacagcucug

SEQ ID NO: 2244765 - RNA, 67 nt, Homo sapiens
gcuuagcaucaugcaguugcuauucauucauguucuguguaucaguuguuccuuuauguugcugagu

SEQ ID NO: 2244766 - RNA, 68 nt, Homo sapiens
cugaccccaugccagggcacugcugggcagacuggcuucuccugcccugcccaguggcuuggggucag

SEQ ID NO: 2244767 - RNA, 61 nt, Homo sapiens
uucuaggcuuuucuuggauccaggugagauuaacucagccugacaccuuuaaaggucagaa

SEQ ID NO: 2244768 - RNA, 69 nt, Homo sapiens
ugucuauccgugguuuccugcuguugaacccauggcuggcccugacggaggacaccugcggaauaggca

SEQ ID NO: 2244769 - RNA, 86 nt, Homo sapiens
uaaguucuaggguacacgugcacaauaugcagguuuguuacauauguauacaucugccauguuggugugcugcacccauuaacuug

SEQ ID NO: 2244770 - RNA, 61 nt, Homo sapiens
ugcccucaugaggcuuaguacauuccugacacacuguguaaaacugagcuaccugggggca

SEQ ID NO: 2244771 - RNA, 110 nt, Homo sapiens
acccaaucccaaaguuaacauacuguaugauuccauuucuauaacauucacgaaauagcaaaauuauaggaaugaacgauuuauugguugccaggcauuaaggaaggggu

SEQ ID NO: 2244772 - RNA, 60 nt, Homo sapiens
auguucagcuugcagugggggaagauagaaaaucgaaauucacaugacagggugaagcau

SEQ ID NO: 2244773 - RNA, 76 nt, Homo sapiens
ugucaucaucagagugcagggaguagcagcaaguugggauucagccagcucuaaacuccuugcucucuuucggaca

SEQ ID NO: 2244774 - RNA, 93 nt, Homo sapiens
caugagauuuggugaggacacagauccaaaccauauaauuccacuccuggcaucugcaaaucuuauguccucacauugcaaaauacaaucaug

SEQ ID NO: 2244775 - RNA, 55 nt, Homo sapiens
gguccagaggcuucauuaagacuuucgacugaauguggagugaagguucuggacc

SEQ ID NO: 2244776 - RNA, 61 nt, Homo sapiens
uuguuauacaucugagucauguuugaucuugaauucauaauuaugaaacaguguagagcaa

SEQ ID NO: 2244777 - RNA, 65 nt, Homo sapiens
gucaucaggugaggauucaaugcacagcuaacaguacucugccuugaaguccucuucuggccgac

SEQ ID NO: 2244778 - RNA, 81 nt, Homo sapiens
caggauuuugcuaugucagccaggcuggucuugaacuccugaccucaggcgaucugccugccuuggcgucucaaagugcug

SEQ ID NO: 2244779 - RNA, 113 nt, Homo sapiens
uucauacagggccuuguguguaguuguagcucauuaauucucagugcagugcaaauauacagcauucacuguugaugggcaugcagguggucgccaguuugggcuauuaugaa

SEQ ID NO: 2244780 - RNA, 56 nt, Homo sapiens
ucaugacacagcauacugacuucaaguuuugaaagaacccagugggcuggucaugg

SEQ ID NO: 2244781 - RNA, 93 nt, Homo sapiens
agaaaaacaggccaaagagagucagucugagcaccaggauuuaaaccuagagagccugacucaagagccugacucaucuuucaccaguuuucu

SEQ ID NO: 2244782 - RNA, 58 nt, Homo sapiens
cuuggcaagagggaugcaagguuugggcuggggcuggggcccaguacccucugccaag

SEQ ID NO: 2244783 - RNA, 69 nt, Homo sapiens
gcagccuugcugacucaaggggaacugcucuucuuaaggcuagcuaauuccuagagauuagcaagcugc

SEQ ID NO: 2244784 - RNA, 107 nt, Homo sapiens
cuagauugagaggaaggagagaauaucaacaugguaggguuggucacuugaguggugaccaagcucgaaauguggguauuauccuugucuccuuccccccagucuag

SEQ ID NO: 2244785 - RNA, 71 nt, Homo sapiens
aaccccagcuuucauggaacuuacaugcuaauaaagcuuggcaagaguauuucaaggaagaugaagugguu

SEQ ID NO: 2244786 - RNA, 62 nt, Homo sapiens
uacuuuaauuuuuuaaggcuuugauuauauuuaaucuccuggccugaugaaauguuagagua

SEQ ID NO: 2244787 - RNA, 56 nt, Homo sapiens
uggcuagaugagauguacugcacguggcuucugcugcaggcaccuacaucuggcca

SEQ ID NO: 2244788 - RNA, 81 nt, Homo sapiens
ccaggaauggacuuuuuguucagugucuccuuucauccucuuugaagagaugcaaauuugaacagacagugucgcuguugg

SEQ ID NO: 2244789 - RNA, 59 nt, Homo sapiens
ggauccaggauccaaucaaaucuagcuguggcguuaccccauggcaggauccaggaucc

SEQ ID NO: 2244790 - RNA, 59 nt, Homo sapiens
guuugccccaaggaugcacucagcaaaguccagacugugagaaucuuuucagggcaaac

SEQ ID NO: 2244791 - RNA, 77 nt, Homo sapiens
uccucuuuacuuccucccuacuacuacgugauuggaucagaaccaaucacguagcaguagggagaaaguaaaaagga

SEQ ID NO: 2244792 - RNA, 64 nt, Homo sapiens
uucgguuugccaguauuuuauugaggauuuuugcaucaaucuucaucagggauauuggccugaa

SEQ ID NO: 2244793 - RNA, 74 nt, Homo sapiens
cuuguaucucuagaaaagacauguugaaguccuaaccccugguaccucagaauguaacuuuaguuggaaauaag

SEQ ID NO: 2244794 - RNA, 60 nt, Homo sapiens
gaucaauuggcugaagacacguuaccuuauuucuuggaucucuguuuugugccauugauc

SEQ ID NO: 2244795 - RNA, 59 nt, Homo sapiens
uaguagugugcgguggauauccuuugcuagguuuaccuaauuucccugcagaccuacua

SEQ ID NO: 2244796 - RNA, 56 nt, Homo sapiens
guugguucuguuuacaugcuggauuauguauauugauuugcauauguugaaccagc

SEQ ID NO: 2244797 - RNA, 129 nt, Homo sapiens
gcauggcguaggcugugcacucaugaccugguaugggguaggcuguauacucugugcucaucacuugauaugaagcaugguguaggcugugcacucauggccugguauggagcauggccuaggcuaugu

SEQ ID NO: 2244798 - RNA, 92 nt, Homo sapiens
uuuacgagucacagcuuucucaucagcaacgugaggauaauaauaggauuuaugucacagguuuuggugaaaauugagaugcuauggguaga

SEQ ID NO: 2244799 - RNA, 61 nt, Homo sapiens
uggaaauaaaugugccaagaucaagguuagggaaugaucucaggcaugguuuguucaucua

SEQ ID NO: 2244800 - RNA, 58 nt, Homo sapiens
uggagugcgagggugaaacuuuauucagaaaaacuugucguuucaaacuuacauuuca

SEQ ID NO: 2244801 - RNA, 69 nt, Homo sapiens
cugccuggguuuuguccucaggaggagucuguguugcucagacauauucggcaaaugcccuuuaggcag

SEQ ID NO: 2244802 - RNA, 103 nt, Homo sapiens
agcauuuaaguaugccaugcacucuguagauucugaggauaaacacaguuguucacagcuauaucacaguaucuagcacagugccuggcacauaguaagugcu

SEQ ID NO: 2244803 - RNA, 56 nt, Homo sapiens
aaaugguggcugugauuuuuguuauccuuauuauuacagugucauggucauuauuu

SEQ ID NO: 2244804 - RNA, 103 nt, Homo sapiens
uugagguggagucucacucugucacccaggcuggagugcaauggcguggucucggcucauugcaaucucugccucccagguucaagugauucuucggccucag

SEQ ID NO: 2244805 - RNA, 105 nt, Homo sapiens
gacuuaaaacuucauuugcaaaguggccuuaauguguguguuugagagauaagucuuaaucucuugcacacaguaaguguuuuguaaauguguauagacuaaguu

SEQ ID NO: 2244806 - RNA, 64 nt, Homo sapiens
gcuuuuagaaaaaguuaagguucuuaaaaugguuguuuucuaguuuuuagcuuuuauugaaagc

SEQ ID NO: 2244807 - RNA, 110 nt, Homo sapiens
uauauauauacaguguguguguauacauaguuguauguauacauauuuuauauauaugguguguguauacauagaauuguguauauauuuuuacauaguguguauauaua

SEQ ID NO: 2244808 - RNA, 72 nt, Homo sapiens
gauuuugucccucucaccaacggggaagaaugguugguuuuauuggguccugcuaagagagggaauaaaauu

SEQ ID NO: 2244809 - RNA, 55 nt, Homo sapiens
agaaugaaacgacaggguuauucagauagcuauuggcuuuguaagguuucauuuu

SEQ ID NO: 2244810 - RNA, 101 nt, Homo sapiens
ugaggcaggagaauuguuugagcccaggaguucgaggcugcagugagccaugaucacaccucuguacuacagccugagcgacugagccagacccugucuca

SEQ ID NO: 2244811 - RNA, 80 nt, Homo sapiens
aguacuuaccugauaggacuauugugaggauuaaaugggauaaaacacuuaaacacuuuauauagucccugguaagugcu

SEQ ID NO: 2244812 - RNA, 61 nt, Homo sapiens
aaggcaacgugaguuguugauuuuuccuuuucuuggugaaauuuaacuggcucuguuccuu

SEQ ID NO: 2244813 - RNA, 124 nt, Homo sapiens
uaacuuuaugcuaauuuuuucuuugccuagcauagugccuugaaaacaaugacaauaacaacuacaacugucauuuucaguuaccuacugugugcaaaggacuuuuaaccuuguauaaauguug

SEQ ID NO: 2244814 - RNA, 80 nt, Homo sapiens
gaauggcacauggagaauguccaggccacuuauacauagauuuaaguaguuaggaacauucucucuugguuuaucuauuc

SEQ ID NO: 2244815 - RNA, 61 nt, Homo sapiens
uagaaaauugccaaagaaaauuauggaucauaauuugucuguguuugguuggcaauuucua

SEQ ID NO: 2244816 - RNA, 71 nt, Homo sapiens
gcccuuguuuuuccauauggauauuacuccacaaagaguaauuacucucugaguaauauccuaugaugggc

SEQ ID NO: 2244817 - RNA, 117 nt, Homo sapiens
caagagggaaagugugagauuuuggaaaauauaugcucugggauccugaaagccaaaccuucucuuuucacaaacucagggugugugacaucuucagaaucaaaugaguucuuuuug

SEQ ID NO: 2244818 - RNA, 74 nt, Homo sapiens
cacuuuucuaacagaugacaagaguguucagggagagguguuucuucaccuuuuuuuuacucuucucaaaagug

SEQ ID NO: 2244819 - RNA, 66 nt, Homo sapiens
uagaaucugugaguuugguuguuuucaagcccugcaaaggguugaguuugaccugaacucugucua

SEQ ID NO: 2244820 - RNA, 80 nt, Homo sapiens
aaaaauccagaagaaauuuugaaacagguugccaggaaauuggauuggcauuuuguuuuagaauuagagccuggucuuuu

SEQ ID NO: 2244821 - RNA, 86 nt, Homo sapiens
uguaugauagguuauuauggcauuauuguucuugcuggauauucauggaaguaggaauuuaauguaugauaauacaucaauguaca

SEQ ID NO: 2244822 - RNA, 93 nt, Homo sapiens
uguguugauaauuuugugauuucaagaguguuauaugaauagaaucauucaguuuguaaacuuuugagauugacuuaauuuucacucaauaua

SEQ ID NO: 2244823 - RNA, 101 nt, Homo sapiens
cuggaaagguguuggggugcagggaaccucaguuauauaccugcaaaaacagauauguuaagauggaacaugggaacucuucccugcaucucuuccuccag

SEQ ID NO: 2244824 - RNA, 75 nt, Homo sapiens
gcagagcugggauaugaccucugucugacaccagaaccuucuguguuguacuaccucucguauuaggggcucugc

SEQ ID NO: 2244825 - RNA, 62 nt, Homo sapiens
gucaccgagugacaguagccaucauggcucacaacagccuugacuuccugcacucaggugau

SEQ ID NO: 2244826 - RNA, 73 nt, Homo sapiens
uugugugucuauguccuaaucuccuguucuuaugugaacaucaguuauauuagauuagggccuauccauauga

SEQ ID NO: 2244827 - RNA, 63 nt, Homo sapiens
ucaguauaaggaggcuacagggcagacuacuggguuugacauguaauguggcucuuaugcuga

SEQ ID NO: 2244828 - RNA, 85 nt, Homo sapiens
gagaauugcaucucugagauguucugauuuuuucaaaucaauacauagaaauuggacauauuuauaggguacaaugugaugucuc

SEQ ID NO: 2244829 - RNA, 112 nt, Homo sapiens
uaguuagaggacacauggcacugaagcguauugacauuucugcuucguuauccuuguuagaacuuagggcugucaggaugccaucagugccccuuucuuggucugauaauua

SEQ ID NO: 2244830 - RNA, 69 nt, Homo sapiens
cugaaaguuauuuauugagcauuuaaagggggcaaaaaucuacuuuggccuuucucuaaauacuuuuag

SEQ ID NO: 2244831 - RNA, 56 nt, Homo sapiens
guggggggaggaguguccgccauugcugaggcuugaguaggcaguuuuccccucac

SEQ ID NO: 2244832 - RNA, 57 nt, Homo sapiens
ugcuauugugaauagugccacaauaaacauaugugugcaugagucuuuauaguagca

SEQ ID NO: 2244833 - RNA, 62 nt, Homo sapiens
gucacugucuacuguaauagccccauuuaaaaaauguugaugugccuuagagagacggugac

SEQ ID NO: 2244834 - RNA, 55 nt, Homo sapiens
uguuucucucauucuguaaucuccccugggauugcaauuuaggugagagaguaca

SEQ ID NO: 2244835 - RNA, 58 nt, Homo sapiens
uauguaacaccguggucauagcauuuauaagauuguacugugauuauuuaguugcaug

SEQ ID NO: 2244836 - RNA, 82 nt, Homo sapiens
gccauuuucacuucuuuugugauucuucaguugcuucaggccaucuggauguauacgugcuggucacaggggauaugauggc

SEQ ID NO: 2244837 - RNA, 77 nt, Homo sapiens
uugcuuuuguugcccaggcuggagugcaguggugugaucucagcuaacugcaaccuccgccucccggguucaagcga

SEQ ID NO: 2244838 - RNA, 74 nt, Homo sapiens
guuuguuuugagacugagucuugcuuugucaccuaagcuggagugccauggcacgaucucaguccacugcaaac

SEQ ID NO: 2244839 - RNA, 63 nt, Homo sapiens
aagaacuguuuacaauuuucacccuggaaagguuuuucucuugugugaacuguagauagucuu

SEQ ID NO: 2244840 - RNA, 76 nt, Homo sapiens
ucgcuugaaccugggaggcugagguugcagugagucaagcuuguuucacugcacuccagccuggguggcauagcga

SEQ ID NO: 2244841 - RNA, 84 nt, Homo sapiens
aagguagccagacaccuagguauguaugucuguacagcgucacguacuuacguugcuguugaggggcugcaccuucuggaccuu

SEQ ID NO: 2244842 - RNA, 79 nt, Homo sapiens
uaggauugaugaggggugguauaugcacacaacuccacaagagucuuuuugugcaagaaucagccuaucauuauuuuug

SEQ ID NO: 2244843 - RNA, 105 nt, Homo sapiens
gaguugcugggguugaguugugucuccaaaaagauguguucaaguuccaaccccuggcgcugugcauaugacuuuauuggaaacaggaucuucgcauauauauuc

SEQ ID NO: 2244844 - RNA, 62 nt, Homo sapiens
gugcugggguagacagaccauggauucacaccacuugcaucauggacugugugacccugcac

SEQ ID NO: 2244845 - RNA, 58 nt, Homo sapiens
ugagcuaggauccugucacuguacugcagccugggugacacagugagauccuaacuca

SEQ ID NO: 2244846 - RNA, 69 nt, Homo sapiens
gagcagucuuugcuucuuguuuacaagaucguuuccaaaaauggcuuuuugggcaaggugcaguggcuc

SEQ ID NO: 2244847 - RNA, 97 nt, Homo sapiens
cugguuuguucugcucuuguuugggccucugauuucuuugggaugucauccucaaagauuauugggcaccaggguacaaugcaggguacaagcucag

SEQ ID NO: 2244848 - RNA, 93 nt, Homo sapiens
guuguuguuuaauggguagggaguuuuaguuuugcaaagaugaaaaacacuuuugcaagaugaaaaaguucuagagaucuguugcacaacgau

SEQ ID NO: 2244849 - RNA, 61 nt, Homo sapiens
guagcagaaugaguguucaaacccagacuguuuggcuuuggagugugcucauaacugcuac

SEQ ID NO: 2244850 - RNA, 55 nt, Homo sapiens
uucaucagcuguagaugucauguuuauacauacacgacaucacuacgguugagag

SEQ ID NO: 2244851 - RNA, 55 nt, Homo sapiens
gaaauggaucagagcaagcuuuuuuuggucauucaucagucuucugauccauuuu

SEQ ID NO: 2244852 - RNA, 63 nt, Homo sapiens
gcagugagcagugagugugcugcaggguuaggagcaggcccucagcauccuccugcucagugc

SEQ ID NO: 2244853 - RNA, 112 nt, Homo sapiens
ggccuauuguucuaacccuucccauguucacauugaauuucugaugacaaagcauauuuauugucuuccauccagauuuuaagugcuguuugugggguuuugagcaguugcc

SEQ ID NO: 2244854 - RNA, 78 nt, Homo sapiens
uugaguuaaugcugaaaugaguuaagacuuugggggauaguuaggaaggcaugacuaguuugaggacauuauacucaa

SEQ ID NO: 2244855 - RNA, 86 nt, Homo sapiens
gggggcugcucaagguggccuggaucuucccgucaaguucaaagcguugacaggaugcucagggcccaccgccuucaucacccccc

SEQ ID NO: 2244856 - RNA, 128 nt, Homo sapiens
agagcuuuuuggacaaguauuuuaagguuuucuagguauauaaucauaucauuggugaacagugauaauuugacuuacucuuuacugauguggaugccuuuuauuucuuucucuugucugauugcucu

SEQ ID NO: 2244857 - RNA, 65 nt, Homo sapiens
ccuggcaguguuucuugugggcucugcuucaacucuucugagccccaagcucgacucugcucagg

SEQ ID NO: 2244858 - RNA, 107 nt, Homo sapiens
guuauggagacuggaaauuucaugaucugggggcacaucuggugggagccuuccugaugguggggacucacugugguguccuuagguaguggcaggcaucacauggc

SEQ ID NO: 2244859 - RNA, 99 nt, Homo sapiens
guuugagugggaagcaaaguaaauacguccauuugugguauaaucacuuugagaugucaauuagauauacaaauggagguguuugguugauauugagau

SEQ ID NO: 2244860 - RNA, 84 nt, Homo sapiens
uccucugaccucugauagcaguagguguucagggcuucggggcccaggccucaucucugcucucggcaggacguacacagagga

SEQ ID NO: 2244861 - RNA, 89 nt, Homo sapiens
aaaauggguacaugaaaagaaacaucaucucuucauuaauugaugcaaugauggcuggaagagaugcuguuaucaacuguagccauuuu

SEQ ID NO: 2244862 - RNA, 58 nt, Homo sapiens
ccccugaugucuagcugaauucaguggagacuuauaaagguagcagacaucauugggg

SEQ ID NO: 2244863 - RNA, 64 nt, Homo sapiens
uucgguuugccaauauuuuacugaggauuuucacaucgauguucaucagagauauuggccugaa

SEQ ID NO: 2244864 - RNA, 65 nt, Homo sapiens
uuucuauucuagguuguggaggggauaagauacucagaggccaccuuucacguaggagaaagaag

SEQ ID NO: 2244865 - RNA, 55 nt, Homo sapiens
gugcaagaggacaguaaggguggagguguggaugcuuaacccagucuuuuugcac

SEQ ID NO: 2244866 - RNA, 110 nt, Homo sapiens
gaccugucaauccuguuggaccaucugugagauuaguucuggaccuggugaccucugucucccagggcaguccaaucuccagugguccccgcaacaggcuggacaagguu

SEQ ID NO: 2244867 - RNA, 94 nt, Homo sapiens
uuugaaucuaccuuuuggcaagcaggacuaaagcaccugaggacucgaauuagugggguuuuguucaugcugucucuuguaaaagguauuuaga

SEQ ID NO: 2244868 - RNA, 60 nt, Homo sapiens
ugugaauagugcugcuaucaacauaggugugcauaugucuuuauggcagaacaauuuaca

SEQ ID NO: 2244869 - RNA, 84 nt, Homo sapiens
aaguacuucaacagucagcccauccacagacccuaccauacagccuucccagaaucucuggaugcacugauuggugaaugacuu

SEQ ID NO: 2244870 - RNA, 72 nt, Homo sapiens
guaaaaucuauaagugacuuugagauuccucaggaaagaccuucugaaaauaugaagucacuuauuguuuac

SEQ ID NO: 2244871 - RNA, 66 nt, Homo sapiens
agaguaccauuacucacuuauuuuuuggggccaaugugcagaauuuacaguugcugaugguacucu

SEQ ID NO: 2244872 - RNA, 71 nt, Homo sapiens
gccagagcccucagaucugcccaccacgaggugggguucagggguggcaaaucugaguggcgcuccacggc

SEQ ID NO: 2244873 - RNA, 66 nt, Homo sapiens
ccgauuuaugucucugacuugauuuauggaaauaauacuaguuguugcaucagcaggcauaauugg

SEQ ID NO: 2244874 - RNA, 129 nt, Homo sapiens
agaucgcaccacugcacuucagccugggugacacagcaagacuccgucucuaaaugaaugaaugaaugaaugaaugaaugaaacggagucuugcucugucacccaggcuggagugcaguggugcaaucu

SEQ ID NO: 2244875 - RNA, 69 nt, Homo sapiens
ucauggggugcuuugcuagauuucuacuuguuauacccuguaaggggccuggacaaagcuauuuuaugg

SEQ ID NO: 2244876 - RNA, 70 nt, Homo sapiens
uguagaagcacaggugaguugguagauggcucuugacauagcaccaccacuaaucucaucgcuaucuaca

SEQ ID NO: 2244877 - RNA, 66 nt, Homo sapiens
ucaaaccauauaaucgguuacacuacaauucaaaacaaauuagggugaaagacauauaugguuuga

SEQ ID NO: 2244878 - RNA, 56 nt, Homo sapiens
gaguagcuguacuaucuuacauuccugccagcaauguaugagagacauggcugcuu

SEQ ID NO: 2244879 - RNA, 58 nt, Homo sapiens
cggucacagugauucaaggguccccaaaaagggugcuguccuuguccauugaugacug

SEQ ID NO: 2244880 - RNA, 60 nt, Homo sapiens
uccauguggccagacacuggcauaagaggcugaaaugccccagugguuggaaacuauggg

SEQ ID NO: 2244881 - RNA, 63 nt, Homo sapiens
cuauguguccacguguucucaucauuuaguucccacuccuaagugagaacaugugguauuugg

SEQ ID NO: 2244882 - RNA, 94 nt, Homo sapiens
gaagaagagaaaagugaguguccauagaagcuuuggggcucuuccucuaaucaggagaaagcugguguguauuauucacuucuuucuuuucuuu

SEQ ID NO: 2244883 - RNA, 89 nt, Homo sapiens
uauaacucuucuauagaaauggcucuguuggcccaagaccucggaugccaguuuucagccaggagcacauuuuugcagggaggguuaua

SEQ ID NO: 2244884 - RNA, 74 nt, Homo sapiens
gggacaugggcaagaaaaaaugccacaaaacauaucaccauuuugaguguggcuuuuucuuggcugaggguucu

SEQ ID NO: 2244885 - RNA, 57 nt, Homo sapiens
ccaucuuugugguguuaucuaccuuuggucuuugauguuggugaccuacagaugugg

SEQ ID NO: 2244886 - RNA, 81 nt, Homo sapiens
acagaaggcagagagccuucaugaccagcucccuggcugguggcggaggugggacugagucauugaggcccucuccucugu

SEQ ID NO: 2244887 - RNA, 105 nt, Homo sapiens
gacagcacccgccaauuugaauucccaggaagauuucaggagagucucuguuaaacaguaugcaaacauacuacauaugacaucuucuuuauccucuuugcuguu

SEQ ID NO: 2244888 - RNA, 75 nt, Homo sapiens
gagguccuucacgucgcuuguaagguggauuccuagguauuuuauucucuuugaagcaauugugaaugggaguuc

SEQ ID NO: 2244889 - RNA, 104 nt, Homo sapiens
uugaggcagaagagucgccugaagccgggagguggagguugcagugagcugauauugcgccauugaacuccaggcugggcgacaagaacgaaacuucgucucaa

SEQ ID NO: 2244890 - RNA, 75 nt, Homo sapiens
cuucaaacuccuugucugagaugacugcaagagcaucagccauuguauccaucuuucaggcaacaggauuugagg

SEQ ID NO: 2244891 - RNA, 74 nt, Homo sapiens
gguuggugcaaaaauaaucacaguuuuugcaauuuuuuaaaaauugcaagacugcaguuacuuuugcaccaacc

SEQ ID NO: 2244892 - RNA, 59 nt, Homo sapiens
auguccauauguugugaucuagaacuccuuuuguuauagcacuuuuuacauauggacau

SEQ ID NO: 2244893 - RNA, 57 nt, Homo sapiens
aagggcuguacccggcuggcugaucauagucgcuugcccaguagcaguacaucccuu

SEQ ID NO: 2244894 - RNA, 89 nt, Homo sapiens
gaacacaacuuauuugacuuucugugguccucuugaaggugauuaaucaccaauuuuagagcaccaagaauugcacaauauuaauguuu

SEQ ID NO: 2244895 - RNA, 82 nt, Homo sapiens
uguaaaauggcuuucuccuacuuaaggccuuccaaugguucuuaucauggaagacucaagguggugaauaccaugaucuaca

SEQ ID NO: 2244896 - RNA, 77 nt, Homo sapiens
uuagcuuccuuucauugggugagaacaugcuccuuuagcucagaggaguuugucauuacccaccuucugaggccuaa

SEQ ID NO: 2244897 - RNA, 56 nt, Homo sapiens
cuucucagugcucaucuuauuuaauauuggcagugggacugugaugcauugaggag

SEQ ID NO: 2244898 - RNA, 60 nt, Homo sapiens
cuguggagcacccacccauuucuuguugugccucagugaaauguaagugaugccccacag

SEQ ID NO: 2244899 - RNA, 64 nt, Homo sapiens
gguguuccccuuaccucuuggccccccaaaacagggacagacauagauggugggcuggaacacc

SEQ ID NO: 2244900 - RNA, 73 nt, Homo sapiens
guucugugauuuuaguucaauuccagaagcauauauagccaugaaggaagcuugagcuaugaguuaauaggac

SEQ ID NO: 2244901 - RNA, 67 nt, Homo sapiens
gugaucacagcuugacuaaaggacuuaaauucgugcacaaugagucccagucaguaggcugugacau

SEQ ID NO: 2244902 - RNA, 60 nt, Homo sapiens
guauuagguuggugcaaaauaaugguaaaagccucaauuacuuuugcaccaagcuaauac

SEQ ID NO: 2244903 - RNA, 58 nt, Homo sapiens
ugagucagggucucacucuguuacccagguuggagugcaguagugagaucuaggcuca

SEQ ID NO: 2244904 - RNA, 65 nt, Homo sapiens
uaagugagcccauuguccugguuuauuguaugcgagcaaaaaugggacuagcaugggcuuguuua

SEQ ID NO: 2244905 - RNA, 70 nt, Homo sapiens
gaaaaggcaacaucugagugggaaagcaaggaugucaauucucacugucaguuucaguguuagccuuuuu

SEQ ID NO: 2244906 - RNA, 122 nt, Homo sapiens
augauucuuuaucauuaugccaaccauuaaaauauucagggccaagcgaaacauuucaacuaaaaacagcuaguugaaugcguuguguggcccguuuccugagagcacuugaggggagucgu

SEQ ID NO: 2244907 - RNA, 66 nt, Homo sapiens
gacaucaguccuaugauaaccauuuaccuuugagauaauuguaccuguuuuaaugggauugauguu

SEQ ID NO: 2244908 - RNA, 69 nt, Homo sapiens
auuagucaaggccaaaguaauuguuagcaguauuuaaugcaugcaagacaucguauuuuggucacugau

SEQ ID NO: 2244909 - RNA, 81 nt, Homo sapiens
ggauguuucacacucucaccaacauuuggcauuaucaauucuuuuaguuuuagcuguucuggagaguguguaauaguaucc

SEQ ID NO: 2244910 - RNA, 61 nt, Homo sapiens
uugucuguacuggcugcaucgauggcugcaggaaggagaguugagcuuuuaguacagacag

SEQ ID NO: 2244911 - RNA, 63 nt, Homo sapiens
cuauggcguucucgucauuuguucuuccccuuugucaugauuaaagcuaugagaacaccguag

SEQ ID NO: 2244912 - RNA, 127 nt, Homo sapiens
cgggaccgccuaacuuagaaucucugaugcuguaggcuaggcgucaguauuuuaaauuuucacacucauaagguugagaucaacugagucagagcauuagcauuagauuaugagaacccgguaucug

SEQ ID NO: 2244913 - RNA, 99 nt, Homo sapiens
gagacaagagaauugcuugaaccugugaggcggaggcugcagugagccgagaucaugccauugcacuccagccuugacacaagagugaaacucugucuc

SEQ ID NO: 2244914 - RNA, 93 nt, Homo sapiens
ggagaaucgcuugaacccgggaguggagguggcagugagccgagaucaugccauugcacuccagccugggcgacaagagugaaaagagucucc

SEQ ID NO: 2244915 - RNA, 130 nt, Homo sapiens
guugaacaucccugguccaaaaaucugaaaucuaaaauguuccaagaucugaaacuugaguggucaugcucaaaggaaaugcucauuggagcauuuuggauuucagauuuuuggauuagggaugcccaac

SEQ ID NO: 2244916 - RNA, 60 nt, Homo sapiens
ucaccaauacuuauuaucuuuugucuuuuugauaacagccaucugauaagugugagguga

SEQ ID NO: 2244917 - RNA, 82 nt, Homo sapiens
uacuuggcaaguugggggauuugugguccaaagucaucuuuacuuuuauuuggagcccuaguuccucauaacccaccaggua

SEQ ID NO: 2244918 - RNA, 58 nt, Homo sapiens
guggagucauacagaacaagacuguuucuuccuaacagugcuucugauaugaugccau

SEQ ID NO: 2244919 - RNA, 76 nt, Homo sapiens
cucaccuucuguguugaugcucauuaauuuucccagucaugagauaaugagcucagauaacaccuuagacaaugag

SEQ ID NO: 2244920 - RNA, 69 nt, Homo sapiens
ugcuccccugggugagcacuccccgccuguccuugccccucaccuggucccugcuccccugggugagca

SEQ ID NO: 2244921 - RNA, 79 nt, Homo sapiens
gugcccacuguugucccugcuguccagugaaauguguucuaucacuuuuaacagccaggggacggccauauaaaggcac

SEQ ID NO: 2244922 - RNA, 62 nt, Homo sapiens
cugaauguuucacucugaaaugggaguccuuggaggguuuugaccagagaagagacauucag

SEQ ID NO: 2244923 - RNA, 70 nt, Homo sapiens
guuucacuaaaacauagccagucaguguauguugaauacccacugggugccauauguuugcuggugaaac

SEQ ID NO: 2244924 - RNA, 82 nt, Homo sapiens
cacuauacacuguuggugggaguguaaacauacuguuuucuacuaugguugaacuaauuuacacucccacaguguauaagug

SEQ ID NO: 2244925 - RNA, 66 nt, Homo sapiens
gauuuugguuagggaaggauacauuucucagagaaaaaaaccugaauuuccccuuaacgcgagguu

SEQ ID NO: 2244926 - RNA, 67 nt, Homo sapiens
gggacaucuuucuagucagggucaaaauacugagaaguuauuucccaguggcuagagcagauauccu

SEQ ID NO: 2244927 - RNA, 56 nt, Homo sapiens
ggggaguguggacaucacccugguucugaaugaacuagggguggcugccauucccu

SEQ ID NO: 2244928 - RNA, 65 nt, Homo sapiens
ggaaagaagcuuugugagaaacuguuuauugaugugugaauucaucucacagaguuaaccuuucc

SEQ ID NO: 2244929 - RNA, 70 nt, Homo sapiens
auacacuacaguucuuaauuaaguaguaacauaguagauacuugauuauuugacuugagaacagguguau

SEQ ID NO: 2244930 - RNA, 80 nt, Homo sapiens
ggagacuguucaggaggcauuuggugggucaugcaaucaggcaucauaugucagguuuagcagaugccucugaacucuuc

SEQ ID NO: 2244931 - RNA, 57 nt, Homo sapiens
agcuucauuccaacuuccuucuuagguuucagagcagaaggaaauuggaaugaagcu

SEQ ID NO: 2244932 - RNA, 62 nt, Homo sapiens
aucaugacacacaucaaaucuaauucucaguugguuuuuaggcgagauguguguuucaugau

SEQ ID NO: 2244933 - RNA, 74 nt, Homo sapiens
gcccccuuugcuggugauuaaauccugaagguacacgaaguauuucagugaaugaauggcuaacagaaaagggc

SEQ ID NO: 2244934 - RNA, 65 nt, Homo sapiens
caaccaaucagauguuuguauaggaguaugaccuuugucauuuuacuucagccucugauugguug

SEQ ID NO: 2244935 - RNA, 74 nt, Homo sapiens
ugcucuccugcugagguggagauugcagugagcugagaucgcaccauugcacuccagccugggcaacaagagca

SEQ ID NO: 2244936 - RNA, 78 nt, Homo sapiens
gugagaaaugagacauuaaaguguguuuggagccuuuuauauauuucaacuuuaaaaacaauuuggugucuccaucau

SEQ ID NO: 2244937 - RNA, 87 nt, Homo sapiens
auguauuguuuuguuuugagaucgaguaucgcugucacccaagcuggagugcaguggcgcgaucucggcucacugcaaagucugcau

SEQ ID NO: 2244938 - RNA, 89 nt, Homo sapiens
ugagauugacaaucucacgugugucuuuguuccagguacgagagucaacacuuuguauguugggucaaaguacaugagucccaaucuca

SEQ ID NO: 2244939 - RNA, 59 nt, Homo sapiens
uauuagguuggugcaaaaguuauggcaaaaacaguaauuacuuuugccccaaccuaaua

SEQ ID NO: 2244940 - RNA, 129 nt, Homo sapiens
gucuugccugguaaaaagugugaaguuucucgggcgacccaguccggugguguucacguuacuugggcuguauucguggaacaccaggcuggcguggcaccagaaaccucagugaggugguaaaagguc

SEQ ID NO: 2244941 - RNA, 64 nt, Homo sapiens
cccuuguugcacugcuuuccuggcccuggaggaggcagggcugggaggaaagugcuggcagggg

SEQ ID NO: 2244942 - RNA, 60 nt, Homo sapiens
cugacauaauaaaugccuguuguuuuaagccacugagugugggggcauuucguuaugcag

SEQ ID NO: 2244943 - RNA, 59 nt, Homo sapiens
aguaauacuagcuagcagggauaauuuagaaaaaugcuuugugcuaaugcuagauuacu

SEQ ID NO: 2244944 - RNA, 125 nt, Homo sapiens
gggcaaauauuuggaugacuauagaaucugcuuaaauacuauggauuuacuguauagggugucaaaguaacaacuguagaguuagagucuauuaaagggggucucaacaaaaaauauuuaugccc

SEQ ID NO: 2244945 - RNA, 93 nt, Homo sapiens
uugaaaccaggcccacaggucucucucaguugucuaauuaguuuaacccauuagagguaaggcagcugugagugaaaaugggcuugauuuuga

SEQ ID NO: 2244946 - RNA, 81 nt, Homo sapiens
guugucacaauguggcuuuacagcaugguucagucaauggggacaggugaaaugaaaacuugguguaaguccucagauaac

SEQ ID NO: 2244947 - RNA, 60 nt, Homo sapiens
aguagcaucauuugcaauuucaugagcaguuagcauacugaaagaaugaaugauguuacu

SEQ ID NO: 2244948 - RNA, 64 nt, Homo sapiens
uuuuuuagaugcagcuaaagcagugcuugagggaaaugcagagcuuuaugcuguguuagaaaag

SEQ ID NO: 2244949 - RNA, 73 nt, Homo sapiens
agagguaagcaguggcaagugcugggcccagaaccaacacuugguugucagcugcuuaguccaaguauccucu

SEQ ID NO: 2244950 - RNA, 78 nt, Homo sapiens
ucccugcuuuuauuuguagcuucccaaagcuuuugcugguaauaaaaggauuguaaaguugacaaauauaagcaggga

SEQ ID NO: 2244951 - RNA, 64 nt, Homo sapiens
gagguguuuuucucagacaaaacaugaauauuuuuugucuuaauugucuagagaaauauaucuc

SEQ ID NO: 2244952 - RNA, 80 nt, Homo sapiens
acuuucuuaaugcaucagugguaguucuuucucccucucacucagcaagguaagaaccaagugguguauuucuggaaagu

SEQ ID NO: 2244953 - RNA, 79 nt, Homo sapiens
ucagguauuuauagcaaugcaagaauggccuaacagaaaacugguaucaggaguggggcaucgcuauaaagauaccuga

SEQ ID NO: 2244954 - RNA, 71 nt, Homo sapiens
cccacugcuuggccucuccccacuccuggaauccacucugauuuuggagcaaaguugaggccaagccuggg

SEQ ID NO: 2244955 - RNA, 78 nt, Homo sapiens
guuauggguuuuucauaaauagguuuuauuauuuugagauauguuccaucaauaccuaguuuauggagagcuuuuagc

SEQ ID NO: 2244956 - RNA, 64 nt, Homo sapiens
auugugaauggugccgcaguaaacauacaugugcaugugucuuuauagcagcaugauuuauaau

SEQ ID NO: 2244957 - RNA, 64 nt, Homo sapiens
augugguaggcccaugagucauucaucuuguaaccuucauggcuuagcacagugccugccacau

SEQ ID NO: 2244958 - RNA, 72 nt, Homo sapiens
cagucuggcuccuucuacuacaugguguuucaaagucacgaaagcuacaugagguuaaaggagucaauacug

SEQ ID NO: 2244959 - RNA, 55 nt, Homo sapiens
uugccuuccuucugccucucucagcugaaacugaagugagucauuuggaaagcaa

SEQ ID NO: 2244960 - RNA, 82 nt, Homo sapiens
gguaaauaccacauauucucacucauaugugggaguuaagaaaaauugaucucauagaggcagagaguaaaugguaguuacc

SEQ ID NO: 2244961 - RNA, 94 nt, Homo sapiens
guaggcuccuucccaccucccgggcugaaaucagauuuguggucagagcuauagagaaugccugaacagcucagcugaggggaaggaagucuac

SEQ ID NO: 2244962 - RNA, 73 nt, Homo sapiens
cauagaauguguaaugaucaagccaggauaucuggguuauccaucacccucaguguuuaucauuauuuuugug

SEQ ID NO: 2244963 - RNA, 107 nt, Homo sapiens
uguaauaaauagauauuuguugagugaaugaaugauuaaaugaaugaccaaacagaaaccacuuaagaaucuauuuacuaacagaaaaaagaaucuauuuacuuaca

SEQ ID NO: 2244964 - RNA, 65 nt, Homo sapiens
ggcucacaaugucuaagauguuucuaucucugugggccuagaaaucuacuuagacuuucugagcc

SEQ ID NO: 2244965 - RNA, 64 nt, Homo sapiens
cucaaauauggcagcccucuuuauccauggagaucuguuccaagacucccgggggcugccugag

SEQ ID NO: 2244966 - RNA, 57 nt, Homo sapiens
ccuuggccuuuggguccugggguggccccugcagucccaagauggaccagaccaagg

SEQ ID NO: 2244967 - RNA, 64 nt, Homo sapiens
auugugaauagugcugcaauaaacauacaugugcaugugucuuuacaguagcaugauuuauaau

SEQ ID NO: 2244968 - RNA, 123 nt, Homo sapiens
guauauauacuguauauaaaauaacaguacauauuuugcacauauuugggcaaaagcuagggacaugacuagcuuuugcccaaauaugggcaaaauauguacuuuuaaaguacagucauauac

SEQ ID NO: 2244969 - RNA, 60 nt, Homo sapiens
gucagaugaguagguagcaaaaauuuucucccauucuuuagguugccuauucacucugau

SEQ ID NO: 2244970 - RNA, 130 nt, Homo sapiens
caaacuucuuuuccugacuuugaccuauccagcccuccaggacuccauuuauuucauuuguucuccaagccgauuuaccaugaagagaaaguggaucuuggauugcucuuuccacugcaggaagaaacug

SEQ ID NO: 2244971 - RNA, 128 nt, Homo sapiens
cuguuuugcaucuccuguuacaggaugugaccauuugacauauccuugcugacaauugaacaaaaugcucuaauacggcaaagaaugagugaguacauaauucugaugaaucugaugaaguaaaacgg

SEQ ID NO: 2244972 - RNA, 63 nt, Homo sapiens
ugagauuuggguggggacagaggcaaaccauaucauucuaccucugcuccccuacaaaucuca

SEQ ID NO: 2244973 - RNA, 80 nt, Homo sapiens
gguuguauagucagagaaauauauuaaagaugcagcauugucugauucuccaguuuccuucgucuaucacuauggcaacc

SEQ ID NO: 2244974 - RNA, 104 nt, Homo sapiens
gggucuuggggguggggaagaccuauauugacuuuccccacaaaugauugcaggcauuugugguagaaauguagaugcuagggaucuccaacucaccuuuuccu

SEQ ID NO: 2244975 - RNA, 69 nt, Homo sapiens
guuaagucugugggaugggcuuugagucuguguauuugggggcuaaagcuuagauccaugguggcugac

SEQ ID NO: 2244976 - RNA, 74 nt, Homo sapiens
uuguuuuuugucauaguacuuuguuuugaaaaguucagaucaacugauaauacuagugcugugaugagacucag

SEQ ID NO: 2244977 - RNA, 63 nt, Homo sapiens
gcagaucucucuccuggauuguaauuucaauuccuuuugauauauaccuagaagagggauugc

SEQ ID NO: 2244978 - RNA, 56 nt, Homo sapiens
acccgggaggcagagguugcagugagccgagauugcaccacuacacacucuugggu

SEQ ID NO: 2244979 - RNA, 68 nt, Homo sapiens
ugauuuguaggaguguguauuaaugaaauuaucccuuugugaugaguuguccauauuuuuucaaguca

SEQ ID NO: 2244980 - RNA, 58 nt, Homo sapiens
gcccugagagcaguguuucggacgcugggaagcgcgcugugcaaagcgcucucggggu

SEQ ID NO: 2244981 - RNA, 97 nt, Homo sapiens
ugccaugaaucauauuaacacauuuccuaauauuaagccaguuuuuauuucuggaauacaguauuaggugaguguauuucaaguauguuauugagca

SEQ ID NO: 2244982 - RNA, 80 nt, Homo sapiens
cagucacaauuuuuacagcuuuugaaucaaauaugaagugccuauaagaaaaucuggaagccuggaaaaaauugugauug

SEQ ID NO: 2244983 - RNA, 89 nt, Homo sapiens
uaaggcaaauuaugucauuuuugaucuuuaggauaacuaacaucuuaaagcauguaauuagguuagaaaaagacauaauuuaugcuuug

SEQ ID NO: 2244984 - RNA, 103 nt, Homo sapiens
ccagcuccaacccacuagaucgcuuggaucucagucuugaugacaagcgagacauccuaaaaauuaagcugaauuuaagcuucggagaggguggguaagcugg

SEQ ID NO: 2244985 - RNA, 59 nt, Homo sapiens
aacuucuacucuauuugagacauugguaauuucagucuucguuuaaagcaguggaaguu

SEQ ID NO: 2244986 - RNA, 67 nt, Homo sapiens
uuaugaagccuguguugaauuauagaaauaaaauuuuaauuauguuuacauuaacauggcuuuguag

SEQ ID NO: 2244987 - RNA, 96 nt, Homo sapiens
agguuagcucagccccaguccagguuagcucagcccagcucagccuugcccagguuagcucagcccagcuaagcucaacuuggcucagcucagccu

SEQ ID NO: 2244988 - RNA, 55 nt, Homo sapiens
ccagauccaguuuucuuuccuagggcuuugacccgaagcuugaaauugagucugg

SEQ ID NO: 2244989 - RNA, 56 nt, Homo sapiens
uugaaguaguacuuuauuauaguaguuuugaaguugcuuuugaaguacuacuuuaa

SEQ ID NO: 2244990 - RNA, 59 nt, Homo sapiens
uauggcuuuuaacugucguaugcaaggaauucccuuaucugacaguaggcagagccaug

SEQ ID NO: 2244991 - RNA, 70 nt, Homo sapiens
gaauguauggcaccauguuaugauaauauaauuguucuuguauuuuauuaagagugguagucaaucauuc

SEQ ID NO: 2244992 - RNA, 57 nt, Homo sapiens
uugagcccauuucacuuguccagcaggugccgcgggcuggacacccaaugggcuuaa

SEQ ID NO: 2244993 - RNA, 62 nt, Homo sapiens
uuguauacugcacauuuagggagggaaggaauuguauuccuuuccuauugcugcuguaacaa

SEQ ID NO: 2244994 - RNA, 75 nt, Homo sapiens
gguuggugcaaaaguaauugcaguuuuuaccauuaagaguaauggcaauaaaaugcaguuacuuuugaaccaacc

SEQ ID NO: 2244995 - RNA, 64 nt, Homo sapiens
cugcugcgugacccaggagugagugaucccccaaccccagaagcucacccugacaucugcccag

SEQ ID NO: 2244996 - RNA, 93 nt, Homo sapiens
ggccaggcaugguggcucacgccuauaaucccaacacuuuaggaggcugagguaaguggauuaugaggucaggaguucgggaccagccuggcc

SEQ ID NO: 2244997 - RNA, 59 nt, Homo sapiens
ugagacugaguuuugcucuuguugcccaggcuggagugcaacgucacaaucucagcuca

SEQ ID NO: 2244998 - RNA, 122 nt, Homo sapiens
auaaagguuaagaauagccugugaguuagcaaaacucccaaagguuuaugaagaaaguuacauuucaauaccuacaggaaguauuugcaugugucuaaggcuggauuguugaaggccuuugu

SEQ ID NO: 2244999 - RNA, 63 nt, Homo sapiens
aagaauuaacagugaauuucaauaugggacugauuucccuacuuggucuucucugugauucuu

SEQ ID NO: 2245000 - RNA, 60 nt, Homo sapiens
ggcuguuguuuuauacuucuaaguuugguauaguuugcuauauaguguaggaaaacagcu

SEQ ID NO: 2245001 - RNA, 71 nt, Homo sapiens
ggagagaagagaaauuguucacauuccaugcuguuuuucuggcauggaaugugaauaacuuccuucacucu

SEQ ID NO: 2245002 - RNA, 106 nt, Homo sapiens
uguaauaauuuguaaaaaugcguguauuuuuaggaaugcgcuauuuccaguaagggaaguauugacauuuuuaaggaacugugcugcauuaaaauccacaguugca

SEQ ID NO: 2245003 - RNA, 72 nt, Homo sapiens
uaagaauacacauuguauguuucugugcacaugacagugugugugugugcacguacauacuguauagucuua

SEQ ID NO: 2245004 - RNA, 74 nt, Homo sapiens
uguauaacauuauacagagaggacagugguaaacuuaggacugcugcccuuucuauaugauguaauuuuauaua

SEQ ID NO: 2245005 - RNA, 86 nt, Homo sapiens
aacuccuggucaggugcaguggcucugaccuguaaucucagcauuuugggaggccgaggugagucgaucacuugaggucaggaguu

SEQ ID NO: 2245006 - RNA, 91 nt, Homo sapiens
gucuuuguccuugguucuaugucaaggugaagaaagaucagcagaauguuggauuucuagcaccuuauuuuuaacuaagcaacgcagagau

SEQ ID NO: 2245007 - RNA, 67 nt, Homo sapiens
uuuucuccuguuaaucugucuuuuguuauugaggguuuagccauaaaccuagcaauggaugaggaaa

SEQ ID NO: 2245008 - RNA, 68 nt, Homo sapiens
cugaaaagcaucugcauagcugccgaggguacaguggcccugcuugagcuugcgaauggccuuuuuag

SEQ ID NO: 2245009 - RNA, 63 nt, Homo sapiens
uauugguguccuaugaaacaggauccacacgugaccaugggcuguggacagaggacaccaaua

SEQ ID NO: 2245010 - RNA, 60 nt, Homo sapiens
ugucaaguugugguucaauuuugagacacaagcaauuccucaagaaacuccagccugaca

SEQ ID NO: 2245011 - RNA, 119 nt, Homo sapiens
cuuagaggaaaggcuuuuauuauuuuacuauucagcgugauauacuagcugugggucugucauauauggcuuuuauuauguuguaguguguucaguuuuucagaguuuuucucauuaag

SEQ ID NO: 2245012 - RNA, 84 nt, Homo sapiens
gaaggcugugagaaggggcauugugucuggguuccuccuuaaagcagaucugaggaaaaccuaagccaguagcucccacccuuu

SEQ ID NO: 2245013 - RNA, 65 nt, Homo sapiens
gcuuaucaucauguuuuugcugugucauccaagucaaugauaaaacuccugaacaagaugagggc

SEQ ID NO: 2245014 - RNA, 59 nt, Homo sapiens
ccuccugaauucauauguuaaaauuuuugccccugaagugauaauaugacuuuaggagg

SEQ ID NO: 2245015 - RNA, 78 nt, Homo sapiens
gugguagaucauguuuccauagaaggccucaacaauaucugcuaccccaugugcucuuuugcaaugugaucuugccac

SEQ ID NO: 2245016 - RNA, 76 nt, Homo sapiens
acugcaguugggacaaagacuccuugaauucagagcugugcuuugaaauucaaggagucuucgucccaauugcagu

SEQ ID NO: 2245017 - RNA, 58 nt, Homo sapiens
guaacauccagauauguaacauuuguaacauccagauauguaacaaucuggauguugc

SEQ ID NO: 2245018 - RNA, 63 nt, Homo sapiens
agcccccgugagcagguucugaucagcucauuuuacaguugaggacacugagcaugggagguu

SEQ ID NO: 2245019 - RNA, 56 nt, Homo sapiens
auugcuuucuaucugugguaccuucccagaugguucacagcuaaaaugaaaguagu

SEQ ID NO: 2245020 - RNA, 58 nt, Homo sapiens
guaggauaugaggauuuuaagacagucagcuuauagcuguuuugcucuuuauaccuau

SEQ ID NO: 2245021 - RNA, 109 nt, Homo sapiens
cugcugguucccccuuuucagcggcacccccucuccaugcacaaauuguaccccucuccaagccauuugugcaugaagagggggugccgcugaaaaggggggccagcag

SEQ ID NO: 2245022 - RNA, 61 nt, Homo sapiens
accaugguaugucuguccacaggaauacucuacagauuccaguggacagacauaccauggu

SEQ ID NO: 2245023 - RNA, 68 nt, Homo sapiens
ggggaauguuaaagaauuugcagaucuauuucuuccuacccucuggcugcaacuuucuuacauuucuc

SEQ ID NO: 2245024 - RNA, 88 nt, Homo sapiens
uguuagauucaaauguauggcaguuucacucugggauuccaccaaaaggaaucuguagggaacaacuguacagaacacagaacugaca

SEQ ID NO: 2245025 - RNA, 69 nt, Homo sapiens
ugggauacaagcagagguagggugugcaguuucugagaagugcauugcaucucugcuucaauccuccca

SEQ ID NO: 2245026 - RNA, 81 nt, Homo sapiens
gggaggcauuucuaucacccauugcacaaagagggaaacugaggccagagagggcacuugcuuccucugugcaauccuccc

SEQ ID NO: 2245027 - RNA, 83 nt, Homo sapiens
cucuggccuagaaaugaauuaacuaaaauucacuuuaugccgaaaggauaaagguaauaauaguugcauuuucuaggccaggg

SEQ ID NO: 2245028 - RNA, 86 nt, Homo sapiens
ggcucgggaaugcugccugugguagauggaguuuugucugcauguacuccacuuucaccacagcggagggaccccagaaaguugcc

SEQ ID NO: 2245029 - RNA, 129 nt, Homo sapiens
ggguaacacaugcuaaaauaagguguugcaccucagcagugguuggaggguaugaugagggcuucuacuuuauugcuauuauuugaccauuguacaaugagacuugauucauguuaaaguuaugaaccc

SEQ ID NO: 2245030 - RNA, 64 nt, Homo sapiens
uggugaggaaaguugaguuucuauacuugagcauaaggagucuugggaauucuuuccuuggcca

SEQ ID NO: 2245031 - RNA, 70 nt, Homo sapiens
uuaucacugcucauguggcauccacuaaaacuguaaguggguggccuuaaaugccacugagcagugguga

SEQ ID NO: 2245032 - RNA, 74 nt, Homo sapiens
ugcagucacagugacaggaugugguucucaucuuggccaagaacaacagcuccauauucugccauugcauugca

SEQ ID NO: 2245033 - RNA, 115 nt, Homo sapiens
gcauccuuuuuauuuugaauuacauagggguagauauggcaucgucaccuuuucagugcuuggagccacugaacagccugaggagucacccuggcuucagagguggaagggaugu

SEQ ID NO: 2245034 - RNA, 73 nt, Homo sapiens
ucaugcuaugugccauucaauucuacaaguauagagagcgaucugucuuguagacugaaggcuucaggcagga

SEQ ID NO: 2245035 - RNA, 83 nt, Homo sapiens
auuaacugaugagagcuaacuguggguacaguuuucuuguauaagcacuuuaccaacauguuugcuuucaguucaacuuuaau

SEQ ID NO: 2245036 - RNA, 65 nt, Homo sapiens
ugucuugucucaguuacggcaauuccaggcacgugcccuggauugccugggcaugagauuuggca

SEQ ID NO: 2245037 - RNA, 65 nt, Homo sapiens
ugaggaggcagucugucccuuagcagagcucaggcacugugcuaggagauccacugcucucuuca

SEQ ID NO: 2245038 - RNA, 67 nt, Homo sapiens
caucagauugagaucaucuaaguagacaucagauugaguaaaaguuucuuagaucuggauucuggug

SEQ ID NO: 2245039 - RNA, 68 nt, Homo sapiens
cagguguuugguugcauggaaaauuuauuuaguggugauuucugagauuuuggugcacccaucaccug

SEQ ID NO: 2245040 - RNA, 129 nt, Homo sapiens
ucuacuauuggcuccauacuaauguuccuugugauuuaaugcgucucugaguuuugcaugucuaagguuauuuacagcuuaaaagaugcauuuauauuaugauuagucaccggugagcuaugaaguaga

SEQ ID NO: 2245041 - RNA, 87 nt, Homo sapiens
cucaaaugacuguaucccagcuuucuuccuggugucugaggcccacaaagucucaguaccugagagugggcagauugcagcuuugag

SEQ ID NO: 2245042 - RNA, 55 nt, Homo sapiens
guauaugccucaguuauagcacuuaccacguggcauuauaauuguuugcauauau

SEQ ID NO: 2245043 - RNA, 71 nt, Homo sapiens
uccugcuacuuuaaacagugaugcaccgaauaucuuuauaacuuugcauauguucaaaguauucuguagga

SEQ ID NO: 2245044 - RNA, 67 nt, Homo sapiens
ccaguaauuugcagacucuagcauguaucagaaugccuugggagcuuguuaacaugcagauuacugg

SEQ ID NO: 2245045 - RNA, 80 nt, Homo sapiens
aauacaguacauaaaaugcuuuugaucuuggaaaaguuucuuauaaagguacuucauucucuggaucagaauacugaguu

SEQ ID NO: 2245046 - RNA, 66 nt, Homo sapiens
cuggaaucucaaugcuuuuguaggccaaggcggaaggauggcuugaguccaggaguuugagaccag

SEQ ID NO: 2245047 - RNA, 55 nt, Homo sapiens
auaaaagcaggucuaggucaggauuggaaaacuauggccccuugcuuguuuuuau

SEQ ID NO: 2245048 - RNA, 105 nt, Homo sapiens
gguugaaugccacaucugugcagaagauagcagcucacuuauuuauggcucagagaaauggagccuaaauuaagcuagcuauugcuggagaguggauaagcggcc

SEQ ID NO: 2245049 - RNA, 59 nt, Homo sapiens
ucuuggcauggcugaagauuccaccauuucucacaagaagaaucucaucugugccaaga

SEQ ID NO: 2245050 - RNA, 69 nt, Homo sapiens
ucagaagcaguaaauacuucaauuacagcuacaaguuccucuuuuugagcugaaguauagggcuucuga

SEQ ID NO: 2245051 - RNA, 62 nt, Homo sapiens
gagauccaucucacaugcaaugauacccauggguucaaaguaaagggauggagacaggucuc

SEQ ID NO: 2245052 - RNA, 56 nt, Homo sapiens
gugaggggaggugcaucugccauuaccgaggcuugaguaggugguuuuccccucac

SEQ ID NO: 2245053 - RNA, 129 nt, Homo sapiens
cuuaauauguaaaguaaaaauuaugcaucugugcaaagucuuagaauuaugaauuaaaaugucagcauuuugguaaucccuagugucuagacuguuuccuuuuugugugugugcuuacuuuauaaugag

SEQ ID NO: 2245054 - RNA, 76 nt, Homo sapiens
uccucguccuuuugucugucugauuguggcaguugagauugaauagagguagacagaggggaaaaaagaaugagga

SEQ ID NO: 2245055 - RNA, 69 nt, Homo sapiens
ggggucuucgucuaugguucaggguggagugcaguggcacgaucauagcuaacuguagccucgaacccc

SEQ ID NO: 2245056 - RNA, 115 nt, Homo sapiens
ugcauugaaucuguagauggcacugggcaguauggucauuuucgugauauugauucuuccaauccaugagcaugggauguauuuccauuuguguuaucuacgauuucguucagca

SEQ ID NO: 2245057 - RNA, 77 nt, Homo sapiens
ugcagauuuccacauggacuuaccuucgccguggcuaauuucaagugacaugagggcaugguucaggaagagaugca

SEQ ID NO: 2245058 - RNA, 59 nt, Homo sapiens
uaccccagguuucuagaauaauuccuuagcuauagggugguuagcaaagaaaccaggua

SEQ ID NO: 2245059 - RNA, 68 nt, Homo sapiens
gguaacuuagcucauggcugugaaaaaccagaccgcugaccagucuuagccugugggucauaguugcc

SEQ ID NO: 2245060 - RNA, 102 nt, Homo sapiens
aggauugacucuuccaauuuugaaaaaaauucugugaauaaaaugcuauuaaauagcauuacaugguacagagaaguauuuugucaaaggaagagucaaccu

SEQ ID NO: 2245061 - RNA, 57 nt, Homo sapiens
ugcagagcuguuaauggagcugaaucugauuuguguuuagccuguaagcacuuugca

SEQ ID NO: 2245062 - RNA, 73 nt, Homo sapiens
gugugaauuauacuguuucugaacuuugauuuuuaccuuccuuaaauuauaaucagaaagaguggacuuacau

SEQ ID NO: 2245063 - RNA, 85 nt, Homo sapiens
ccaccugucaauguggguuuccuaagcaucagugggaaugaggaccccauguacugguguaugggaggucccaaggccacagugg

SEQ ID NO: 2245064 - RNA, 89 nt, Homo sapiens
ucucacuaugucuccucagcuccuaucucuguauggccugguuuuuccuagguuaugauuauagagcgaggauuauuauaauauuggga

SEQ ID NO: 2245065 - RNA, 59 nt, Homo sapiens
ggcagagagcaucuuguugggaagagcccugccugccuucccguugcugugcuccugcc

SEQ ID NO: 2245066 - RNA, 70 nt, Homo sapiens
uuguggugucagagagcucuucuguuauucucugaaauauaaugacagguuuucuguuucugaaacacaa

SEQ ID NO: 2245067 - RNA, 87 nt, Homo sapiens
uaauuguugagcuaguagauuuuaaauauuuccacuacaaaauaaguauguaagguaauguguagguuaauuagcuugauuuaauua

SEQ ID NO: 2245068 - RNA, 89 nt, Homo sapiens
gugaugauugugcuggaggaauaugcuuauuagcaagaaauacuaaaguauuugggcaugauggggcauuuucacaguuuaagcuuugc

SEQ ID NO: 2245069 - RNA, 58 nt, Homo sapiens
gggaaagaccuuccugggguguggccuuugucuguuuugucccgggugggcuguuccc

SEQ ID NO: 2245070 - RNA, 57 nt, Homo sapiens
guggcgaagauggauugagucauagauuugacuggaaauuggauccacuucugccac

SEQ ID NO: 2245071 - RNA, 76 nt, Homo sapiens
ggggaacagcuugggcucugccauuugcugacugcgugacccuggguggaugguucaguugcacaggcuguucucu

SEQ ID NO: 2245072 - RNA, 74 nt, Homo sapiens
cuggagcaugcuuccauaguauuuuuacaaaauccaaaagacuuuuguccaauagaauuauggacauguaccag

SEQ ID NO: 2245073 - RNA, 60 nt, Homo sapiens
ugaaauuauucuuaccaaggugauauccaggaucucugcccuuguucaggaauaguuuca

SEQ ID NO: 2245074 - RNA, 91 nt, Homo sapiens
ggagaaucgcucgaacccgagagguggagguugcagugagccgagauuaugccacugcacuccaaccuguugggcgacagagcgaaacucc

SEQ ID NO: 2245075 - RNA, 77 nt, Homo sapiens
uucagguuagaaacagggguauaauagaguuugagauuuguagccuaacuauuccuugcuccauuuucuagccugaa

SEQ ID NO: 2245076 - RNA, 81 nt, Homo sapiens
ucuugaugguugagcuucauuguuaugaaugucaaagacuaauuugcauuuaagaaaacaugagucuacaauaacucagga

SEQ ID NO: 2245077 - RNA, 67 nt, Homo sapiens
caagugguuuuaucccagaaauuaauguaacuuauuacauuaauagauuaaagggaagaaccauuug

SEQ ID NO: 2245078 - RNA, 62 nt, Homo sapiens
ucagagcugccuaaugaacacuuucuuacauucuggaagcaaaguguuuuuaggaagucuga

SEQ ID NO: 2245079 - RNA, 79 nt, Homo sapiens
ggcagcaggauuggacaaagucacaaaaucccacaacuuggcaacacagguuuugugacucauggucuagugcucuguc

SEQ ID NO: 2245080 - RNA, 80 nt, Homo sapiens
gcugcuuucugauuacucacauucuguuucuugcuuuuaaaaaaacaguaaagacaagaguguuggaccaguauugcagu

SEQ ID NO: 2245081 - RNA, 58 nt, Homo sapiens
guuagagcuuuuuauaaucuugcuuauugcuuauugcaggucaugaagauguucuaau

SEQ ID NO: 2245082 - RNA, 77 nt, Homo sapiens
gguucuugguaauaggcuauugcuguaguuuauugguccaucuuauagguuauuagagcaaagcuugugucagaacu

SEQ ID NO: 2245083 - RNA, 73 nt, Homo sapiens
ccuacacugucugaugaaaguaguucgaggggagaaggggaaccuuggaaugaacugccagcaggcgguaagg

SEQ ID NO: 2245084 - RNA, 79 nt, Homo sapiens
uacuuugaauacaguaucuucuggcaagcacuggggacugcagucgacaaugcugcugaauauaccugaguacauagua

SEQ ID NO: 2245085 - RNA, 67 nt, Homo sapiens
gugagauuuggguagggacacagauccaaaacauaucauuuugccucuggccccucccaaaucucau

SEQ ID NO: 2245086 - RNA, 70 nt, Homo sapiens
gacugugaaaugcaagguauauucaugagagaacugcgacucucacaugaagauuuuaguauacacgguu

SEQ ID NO: 2245087 - RNA, 61 nt, Homo sapiens
ggaggugaauggauuuuuaaaaaugugguagaaacacacaauggaaugcuauucaaccuuu

SEQ ID NO: 2245088 - RNA, 61 nt, Homo sapiens
gaagaguuuaauucuuaagguaauauggcucucuagggcagaaacuggaauuaaacuuuuu

SEQ ID NO: 2245089 - RNA, 94 nt, Homo sapiens
ugaggcaggagaaucacuugaauccagaagguggagguugcagugagccaagccauugcacaccagucugggcaaagagugaaacucugucuca

SEQ ID NO: 2245090 - RNA, 70 nt, Homo sapiens
uuacugagaaugaugauuuccaauuucauccaugucccuacaaaggacaugaacucaucauuuuuugugg

SEQ ID NO: 2245091 - RNA, 83 nt, Homo sapiens
cuggggaacccacugcccauuuugccagaugucagcucugaaaguaccucgguccugggcaaaauggccagugggucaccugg

SEQ ID NO: 2245092 - RNA, 60 nt, Homo sapiens
acacaagcagggacucaauggcuguuucuggaaugacaaugaaucccuguuucacagugu

SEQ ID NO: 2245093 - RNA, 95 nt, Homo sapiens
uucuucugcuuagcuaacucugcauuaaacucuuucucuacugcaguaccauggucucagugaauugguuuugucugugcagcagguagaaagag

SEQ ID NO: 2245094 - RNA, 127 nt, Homo sapiens
ggguggaccauggaugguuuaggaaaaggcaacauuugagugggaaaacagggauagaaguucucacuuugggccauggcuuuuccacgaggguggggcuucaucagggaccugcuguugucugccu

SEQ ID NO: 2245095 - RNA, 68 nt, Homo sapiens
uagguuauuugcauaucuucauuauugugaauaaugcugcagugaacaaagaagugcagauacauuua

SEQ ID NO: 2245096 - RNA, 69 nt, Homo sapiens
cuugacagggcugcuauuguuuaaaaguuauuuugccgaaauugcuagaugaaaaugguaccuugcaag

SEQ ID NO: 2245097 - RNA, 111 nt, Homo sapiens
uucgugugugcauaugugcaugugagugcacagaugugcaugugugagugcaugugugugugcaucagguacaugcaugugugugcauaugugugcgugugugcaugugaa

SEQ ID NO: 2245098 - RNA, 56 nt, Homo sapiens
guuugucccuuugcaguggcacacagggagcuauguguccacaagaggagacgaac

SEQ ID NO: 2245099 - RNA, 75 nt, Homo sapiens
uugcuugaacgucagaggcagagguugcagugagugagauugcgccacugcacuccagccuggacgacagagcga

SEQ ID NO: 2245100 - RNA, 92 nt, Homo sapiens
aauaaagcuguacuuaucuaugaauguuaguauguguggguguacacauauacacccauacacacauauuuaugugauaaguaugccuuauu

SEQ ID NO: 2245101 - RNA, 102 nt, Homo sapiens
ugaggcaggagaaucacuugaacccagaaggcggagguugcagugagcagagauugcaccauugcacuccagccugggcaacaagagugaaacuccaucuca

SEQ ID NO: 2245102 - RNA, 71 nt, Homo sapiens
guauagcacauaauacuugaugaggaaaauaaaugauuauacuacugguuuagguauuuacuaugcuguac

SEQ ID NO: 2245103 - RNA, 68 nt, Homo sapiens
uggcaaauuccaaaguuaauucaaggucaaaagacugaauuuagaauuugauuuuaggaaguuuguca

SEQ ID NO: 2245104 - RNA, 90 nt, Homo sapiens
ggggguuaugaguauuggucuugaaaccagagagaccuggguucaaaucccagcucccuuacuugguugucaaaccuugaacaagucccc

SEQ ID NO: 2245105 - RNA, 84 nt, Homo sapiens
uucuagaaggcaaugauggagguagauuguccauaauaaagggugugaugggcccucucuacuuuuaucagagcacagcuggaa

SEQ ID NO: 2245106 - RNA, 86 nt, Homo sapiens
ggagucuugcucuguugccuaggcuggagugcaguggcaugaacucggcucacugcaaccuccaccucccagguucaagcgauucu

SEQ ID NO: 2245107 - RNA, 57 nt, Homo sapiens
ucauucucucaucugugaauaaagaucaaauaguucugccucacaguguuaggauga

SEQ ID NO: 2245108 - RNA, 80 nt, Homo sapiens
uucuagcaccugcgguguuggcguugucaugggaauucugcaggcuuuagacaacugaaacacugugcaacugugcagaa

SEQ ID NO: 2245109 - RNA, 77 nt, Homo sapiens
gcuauauaccugaugaagacuguuugguaaucuaauguguauuccauagguccauuauuuucauucauguauauggc

SEQ ID NO: 2245110 - RNA, 103 nt, Homo sapiens
ggaguuaagucuggguaaacccguuguaaguuggaaaugucuuagaaugcaccuuugaccuagguauuuucaacuuagaauggguuuaucaggauguaacucc

SEQ ID NO: 2245111 - RNA, 61 nt, Homo sapiens
uugaggcugcuugugcacaaaauaggaagcacuuguguaagagcugcauaggcaggcucag

SEQ ID NO: 2245112 - RNA, 62 nt, Homo sapiens
ugcagucuggcaauggcagacuggcagucuggaggcaugccaugucuuuauucucaacugca

SEQ ID NO: 2245113 - RNA, 79 nt, Homo sapiens
augcucaggugccuuggcuaauuguuaucugguuauuaucuaucaaggaacaauuacuaccaaggccuguaggaggcau

SEQ ID NO: 2245114 - RNA, 95 nt, Homo sapiens
agguguaaaagugauauugugauuaugguuuuuagcagaguaauuaucuguaagaauugcgugcugaaacaugacagaaaucugguagcucaccu

SEQ ID NO: 2245115 - RNA, 71 nt, Homo sapiens
aaggcagggaccuugucacauuugcccgguauucccaaugccuagcacaaugccugacgaguccuggccuu

SEQ ID NO: 2245116 - RNA, 74 nt, Homo sapiens
ucagaauuggaacugaaauaauaacuucaaagaaaagaaaacuuacuaagguuauauuuguaguucaguuuuga

SEQ ID NO: 2245117 - RNA, 59 nt, Homo sapiens
uggagguuugcugaaugccauuuguaugaauaccauuuagguauuugguaaacucucca

SEQ ID NO: 2245118 - RNA, 60 nt, Homo sapiens
agacccaucugugugcuguauucaggagacccaucucaugugcagacacacauauaggcu

SEQ ID NO: 2245119 - RNA, 63 nt, Homo sapiens
gcgaaugugggaguccacugcccggcagauggagagagccucugcggguguggacccuagugc

SEQ ID NO: 2245120 - RNA, 57 nt, Homo sapiens
aguaucauuagggggauuauauauauggggagaaccaaucccauuccugaagauacu

SEQ ID NO: 2245121 - RNA, 77 nt, Homo sapiens
ucuuccuaccuaaagaccauuaacugaaucucauguuuaucuacagagaucacagucuuugguuuuaggugugaaga

SEQ ID NO: 2245122 - RNA, 73 nt, Homo sapiens
ucugaugagaauguguuaaaauggagacucucaucauugcuugugagaguauaaauugaugcagccucucaga

SEQ ID NO: 2245123 - RNA, 60 nt, Homo sapiens
caauuaggucccacaugacaauuuucacuuuuguuacaauugcuuuugaggacuuaguug

SEQ ID NO: 2245124 - RNA, 90 nt, Homo sapiens
cucauugaaugcucacaaccuuaugaagcaugaauuaccccuuugcuuucagccaauggucaugccuuccauaaugugggaaagaaugag

SEQ ID NO: 2245125 - RNA, 78 nt, Homo sapiens
uuuuggcuauuguuaacagugcuguuauaaauguacaugugcauguauuuguuugaguacuuguuuucauuucuagaa

SEQ ID NO: 2245126 - RNA, 68 nt, Homo sapiens
ugcaaguuuccguccagccccacugcccugugagugcagcaggcaccauggaaggacgggagcaugca

SEQ ID NO: 2245127 - RNA, 55 nt, Homo sapiens
guguggcaguucuccuugauggguuguaaaugcccucaaggcaggaacuguacau

SEQ ID NO: 2245128 - RNA, 81 nt, Homo sapiens
ugguucauaguucugcagacauuacaagaagcauggugccagcaucugcuccuggugaggguuucagggagcuuacaauca

SEQ ID NO: 2245129 - RNA, 63 nt, Homo sapiens
ccaguaugcguucucuuggauagcagauggauggauggcugccauucauggaggagcaauugg

SEQ ID NO: 2245130 - RNA, 77 nt, Homo sapiens
uaguuuacugagaaugaugauuuccaguuucauccaugucccuacaaagaacaugaacucaucauuuuuuauggcug

SEQ ID NO: 2245131 - RNA, 55 nt, Homo sapiens
uccucagagaugcgaaggcaggccucggagagcgugucgugcaggaucuguggga

SEQ ID NO: 2245132 - RNA, 106 nt, Homo sapiens
uucuuucaugauauugaaaagaacuggaagaagugaaagcuuugccacauugcuugcauucauaguguuuccuuccagugugagucuuuucaugucuaugaaagga

SEQ ID NO: 2245133 - RNA, 79 nt, Homo sapiens
ccugccgucccucaggagucccauuggucugcggggggcacaaauucugcauggaguggaaauucuuggguacgacagg

SEQ ID NO: 2245134 - RNA, 72 nt, Homo sapiens
agccuuuccaaauacuaaagugcuuaaaaucucauuuauucucugauaaaagaauuugcacuuugggaggcu

SEQ ID NO: 2245135 - RNA, 60 nt, Homo sapiens
aucagcagcgguggcugcagaacagcggauauuggugaacugcaaaugcugcugccugau

SEQ ID NO: 2245136 - RNA, 104 nt, Homo sapiens
guguauuugacauacuggucccuuaaggaguagugucugguauuugaguaggcgguuauuugagagucacacacuuuuuuuaguauuuaauaugucguuuacau

SEQ ID NO: 2245137 - RNA, 64 nt, Homo sapiens
ucauugguucuggguguuguuggaggucaaaguuuuuucuacggcacaugcccaggcuacauga

SEQ ID NO: 2245138 - RNA, 79 nt, Homo sapiens
uuuagggacugcauaacugauuaaaaauuaccuuauuuuacauuauugggugguuuuauuaucagugacuauuccuaaa

SEQ ID NO: 2245139 - RNA, 70 nt, Homo sapiens
ucaagauauauaucaaagaaucaagauagugagguucacagcuucuugauagguuuuauguauaguuuga

SEQ ID NO: 2245140 - RNA, 87 nt, Homo sapiens
aaggugguaguacuacaguagagaggauguagaaauagggcagaaguuguuaagucuugcucugcuguugacuacccaugugaccuu

SEQ ID NO: 2245141 - RNA, 55 nt, Homo sapiens
uugagauggagucucgcucugucgcccagacuggagugcaguggcaccaucucag

SEQ ID NO: 2245142 - RNA, 67 nt, Homo sapiens
cuucugccugagacucagaaugagacuguggaucaugacagaaucaaauuccaagucuagguaggag

SEQ ID NO: 2245143 - RNA, 61 nt, Homo sapiens
aacuucccugaaauauucacuuucacccugcucugaacaguuaggauuucagggagaaguu

SEQ ID NO: 2245144 - RNA, 62 nt, Homo sapiens
ggaguauucccugguuaaggaaagguuuacuaaagagaacuuccugagagaggaguaacucu

SEQ ID NO: 2245145 - RNA, 77 nt, Homo sapiens
gcaguuuucuagcaguggaaucuguuauacuaacucuuugaaugaguaacugaaacagauucugaaacugaaacugc

SEQ ID NO: 2245146 - RNA, 81 nt, Homo sapiens
gugguuucucaaaccucuuaauggccuguaaucuuucaacaguuaagaguauugcuaauaagagauuugagaacaauuugc

SEQ ID NO: 2245147 - RNA, 64 nt, Homo sapiens
auugugaauagugcugcaauaaacauacaugugcauguguccuuagagcagcaugauuuauaau

SEQ ID NO: 2245148 - RNA, 72 nt, Homo sapiens
uguaugugacuggaacaguaggaagccugcacgaugguaacagauccugcuguuucugagucagucuauaca

SEQ ID NO: 2245149 - RNA, 63 nt, Homo sapiens
gaggaagucugucuagaacugauacaguauauccacagugcuaucagagacccaggcuuccuc

SEQ ID NO: 2245150 - RNA, 65 nt, Homo sapiens
cuggagaaggagaaaugaaucaagguauggaaggauugaaauuuugugacacucuccaucuccag

SEQ ID NO: 2245151 - RNA, 80 nt, Homo sapiens
aguucuggacuggcaaauucuuuaaguaucucuuguuuuauggaauaauacagugaauacuuacaguguuugcaagaacu

SEQ ID NO: 2245152 - RNA, 71 nt, Homo sapiens
gaauucaguuugcuaguguuugguugaugguuuuugcauuaauaaucaucaaggauauuggucuguaguuu

SEQ ID NO: 2245153 - RNA, 59 nt, Homo sapiens
uggauauaaaacauuuuguuuauccauucaucaguugaugaauauuuggguugugucca

SEQ ID NO: 2245154 - RNA, 60 nt, Homo sapiens
auuaggacaauggucugcaaaucacugacauuugaggauugauagugccuuugugcuaau

SEQ ID NO: 2245155 - RNA, 79 nt, Homo sapiens
aggcuggagugcaaaugggaugauuaugguucacuacagccuuuuucuuuggagaucagcaaucaucacacuucagccu

SEQ ID NO: 2245156 - RNA, 92 nt, Homo sapiens
ucauaucacaggguguacacccacugugauauuaaaaggaauaucuuucuagaacauuacaaauaguaucacaagguguacacccacuauga

SEQ ID NO: 2245157 - RNA, 63 nt, Homo sapiens
aaucacaguggcucacaagagccaguuguagcaacccagcuguuguucuuggucacucugauu

SEQ ID NO: 2245158 - RNA, 62 nt, Homo sapiens
ucaucucugauacugagaccuuggguuaggacuauucugaaaggguuucggauuagcaaugg

SEQ ID NO: 2245159 - RNA, 55 nt, Homo sapiens
ucacugggagcauuugagccuuuaaauuacuuacaggauucaaagcccacaguga

SEQ ID NO: 2245160 - RNA, 93 nt, Homo sapiens
ccagcuggagugcaaggacaugauaucagcucacugcaaccucugcuucccggguucgagcaauugucaugucucagccuccugaguagcugg

SEQ ID NO: 2245161 - RNA, 70 nt, Homo sapiens
uucucaugaugugcaggugaaagaagccagucauucaaugacaagagccuucuuuccuucacuuccagaa

SEQ ID NO: 2245162 - RNA, 56 nt, Homo sapiens
uugggacccuguccuguaacaauagcgucucacuguguugcucagauuggucucaa

SEQ ID NO: 2245163 - RNA, 62 nt, Homo sapiens
cuggguugaauguuguugguugagauauaauuuguuugggucucaaauuuugauauuuccag

SEQ ID NO: 2245164 - RNA, 68 nt, Homo sapiens
aaaucauaugguucccuagguaugaaaaugcacuccaguauuaucaccuugcaggagcuaugagauuu

SEQ ID NO: 2245165 - RNA, 57 nt, Homo sapiens
uuaguaucauccuucugcauucagcuacuugcugauaaaaaccagaggguguacuga

SEQ ID NO: 2245166 - RNA, 82 nt, Homo sapiens
uaguuuccauguuguugugcaguuuugagugaauuucuuaaucaugaauucugauuagauugcacuguggucugagagacug

SEQ ID NO: 2245167 - RNA, 73 nt, Homo sapiens
uggggucaggaguucaagaccagccugggcaacauggugaaaccccaggcaacaugguaaaacccugucucua

SEQ ID NO: 2245168 - RNA, 73 nt, Homo sapiens
cucuggugucucaaauuacgagaaaauauauaaaacauguaauugcuucuguauuuuggacacucauuaggag

SEQ ID NO: 2245169 - RNA, 97 nt, Homo sapiens
uucuggccccaacaauauauaagcugaugagccacaaugauauauaaaaccugucaaccaaguauuugugaaucagcuguauagauuguuggcagga

SEQ ID NO: 2245170 - RNA, 55 nt, Homo sapiens
aguuagaaaucugcaguugacacaaauucacaucuguuaacugugggaacuaacu

SEQ ID NO: 2245171 - RNA, 76 nt, Homo sapiens
ucacuugaacccgugaggcggagguuacagugagcaaagauuuugucacugcacuccagucugggugacagaguga

SEQ ID NO: 2245172 - RNA, 64 nt, Homo sapiens
uuuuacacuucgguugugugcauacacuuguguauuugauguuuuaugcaacaaaaguguaaga

SEQ ID NO: 2245173 - RNA, 66 nt, Homo sapiens
ucccggcugugugacugugggcagucccugagaugggggauuuguuuguucaucugcacaguggga

SEQ ID NO: 2245174 - RNA, 76 nt, Homo sapiens
uugcucuguugccuaggcuggcgugcaguugugcaaucucagcucacugcaaccucugccuccuggguucgagcga

SEQ ID NO: 2245175 - RNA, 89 nt, Homo sapiens
agcagcucucugccaacuggagugucugugcuggucaaagggucucuuccugcuaagauuccagaggcucguggugagacaggguugcu

SEQ ID NO: 2245176 - RNA, 55 nt, Homo sapiens
ggcaaggauuagauucuccccuauagccccuggggagggagagugcagccuuguc

SEQ ID NO: 2245177 - RNA, 77 nt, Homo sapiens
acuugcaauuagaaaaguccuaauuaauacaguggguuuugcaucucugacuuauguggacuauuucauuuugaagu

SEQ ID NO: 2245178 - RNA, 128 nt, Homo sapiens
ucuuuucugcauguagcgagcaucucauuuacuuuugguuauuugaaacuagcauacuuuugcauauguccaguuacaggaaaccaacuuacgagaguuaugaacugccugcccggagccagauagga

SEQ ID NO: 2245179 - RNA, 63 nt, Homo sapiens
ucuuuguuagaacccucuccuucacccccagagcaggaaggagaguggugucucuagcaaaga

SEQ ID NO: 2245180 - RNA, 90 nt, Homo sapiens
ugccaaguaauaucucacugcauggucuagcuggguugacaucccauugcacgcucuagcugggcugugaaggagcagacugcuugugca

SEQ ID NO: 2245181 - RNA, 58 nt, Homo sapiens
uccagggguuaggggccugaagaucuggugucugauguuugcagagcccaacccugga

SEQ ID NO: 2245182 - RNA, 56 nt, Homo sapiens
aguuauaguauuuuugcugguggaaggucuucccucaguguugauggcugcugacu

SEQ ID NO: 2245183 - RNA, 84 nt, Homo sapiens
ucagguaugucuuuauuagcagcaugagaauggacuaacacaaugucuuagucuuuuuucugcugcuuauaacagaauaccuga

SEQ ID NO: 2245184 - RNA, 105 nt, Homo sapiens
gcucaaagaggugagguaacucucccaggguuccacgccuggcugugugcaugaccugcuacaaccagcaugaaaccuugagcagguuacuucacuucucugagc

SEQ ID NO: 2245185 - RNA, 77 nt, Homo sapiens
augguagcaaagcugagaugagaaucaguucuaauuuuaaauugagagcucuuuucauuauacuacgcugcugcuau

SEQ ID NO: 2245186 - RNA, 66 nt, Homo sapiens
cauucauucauucaacagcugauggauauuuggguucuuucuacucuuuggcugugaagaauaaug

SEQ ID NO: 2245187 - RNA, 60 nt, Homo sapiens
acuguaauaauuuugaagccaccuccuauugcuauuauggugagcucaauuguugcaagu

SEQ ID NO: 2245188 - RNA, 84 nt, Homo sapiens
gauugucagaggugucugagguuggggucagggcuagcagugugcugcagcggcuggccucagcuugagcaacccaacucaauc

SEQ ID NO: 2245189 - RNA, 106 nt, Homo sapiens
ugggugagagagagaauaagauuagaauacccuuagcuuacauucuaggaacauauaauuucuagagcuaaaggagguaauuuuuuccagcuucuuucaucaccua

SEQ ID NO: 2245190 - RNA, 72 nt, Homo sapiens
cucuguggucagaguccuuggccaccccucaggaucuaggcuguuggagaggccacagagucugcuacaggg

SEQ ID NO: 2245191 - RNA, 93 nt, Homo sapiens
uuuccauuagugaggcuacaguuauguuuuaaaugugcgauuacagagauggcaucugaacauaaacugauggcucgaaaaugaaaauggaaa

SEQ ID NO: 2245192 - RNA, 69 nt, Homo sapiens
caucuggagaccaggguagagccacugauggaggacaggacagugguuuucaacccugguugcacggug

SEQ ID NO: 2245193 - RNA, 87 nt, Homo sapiens
ggaauacacaguugcucuuugguauuuguggggaauuuguuccaggaaucccccaugaauaucaaaaucugagaaugcucaaguucc

SEQ ID NO: 2245194 - RNA, 57 nt, Homo sapiens
gaggcagucugucccuuagcagagcucgaguacugugcugggugaucagcugcucuc

SEQ ID NO: 2245195 - RNA, 67 nt, Homo sapiens
uagguucuaagccacagccauuuuuccuuauuuauuucuggcaaaauuugguguuguuuggagccua

SEQ ID NO: 2245196 - RNA, 58 nt, Homo sapiens
uucuguccuuuugaauuccaaaaguguguuggccugugagauagcauaagggacagaa

SEQ ID NO: 2245197 - RNA, 61 nt, Homo sapiens
cccucuacagggaagcgcuuucuguugucugaaagaaaagaaagugcuuccuuuuagaggg

SEQ ID NO: 2245198 - RNA, 58 nt, Homo sapiens
gauggccuucggugggccacugcauaaauggauguuucugcaguauugaaggccaguc

SEQ ID NO: 2245199 - RNA, 77 nt, Homo sapiens
acauguuauagccuacuccacaccugggcuauaugguauagcccauuguuccuaggcuacaaaccuguauagcaugu

SEQ ID NO: 2245200 - RNA, 66 nt, Homo sapiens
uggguuaggcagugugguauagcagauaugugguuaacaucauugcugugucauuuguuuaaucug

SEQ ID NO: 2245201 - RNA, 76 nt, Homo sapiens
cuaaaguauggacaagcuuuucuggauccgucauuuucaugcuauagaacuucccaggagauguuuguccuuuuag

SEQ ID NO: 2245202 - RNA, 103 nt, Homo sapiens
gucugguggggacuuggagaaccuuuaugucuagcucagggauuguaaacacaccaaucagcacccuguguuuagcugaagguuugugagugcaccaaucgac

SEQ ID NO: 2245203 - RNA, 55 nt, Homo sapiens
cuugaaagugacagugagaaaugcauaccuaguagaacucacaguaacuuuuaag

SEQ ID NO: 2245204 - RNA, 55 nt, Homo sapiens
aaggaguguggugaucuugggcagauuacucuagucucugauccucacauuuuuu

SEQ ID NO: 2245205 - RNA, 67 nt, Homo sapiens
uuaucagcagcaugaaaagcaacuaauacaguaaauugguaucaguugagugaagugcuacugauaa

SEQ ID NO: 2245206 - RNA, 61 nt, Homo sapiens
caggacgcauacacguuaggcgaagucauccuuggugguguuucuauggugaugaguccug

SEQ ID NO: 2245207 - RNA, 62 nt, Homo sapiens
ugccugaaaguuauucaggggcaaguuguuuaauuuccuugcaacuuugugauuuuaaggua

SEQ ID NO: 2245208 - RNA, 57 nt, Homo sapiens
uagggugucacagugcucauaauucaccucagauuaugaaaucacugugaugcccua

SEQ ID NO: 2245209 - RNA, 87 nt, Homo sapiens
ucuccugcugugacccucaagauggaagcaguuucuguugucugaaaggaaagaaagugcuuccuuuuugaggguuacuguuugaga

SEQ ID NO: 2245210 - RNA, 66 nt, Homo sapiens
cugggguaaaggucacucaugcuaugcuuuaggaaagagacugauggcauugugcccuugcucuag

SEQ ID NO: 2245211 - RNA, 55 nt, Homo sapiens
ucaguuuuuaagaguuaugcgacuugaauagugauuugcaaauucuaaaaacuga

SEQ ID NO: 2245212 - RNA, 111 nt, Homo sapiens
acuuccuuuuaauauaguacaguauagcacaauuugcaguuaugucuuaauaugugaucaggaaugaucaugacuggaaacaguguuauuugugguagcuauaggguaggu

SEQ ID NO: 2245213 - RNA, 58 nt, Homo sapiens
ugagaucgaguuucgcucuuguugcccaggcuggagugcaauggcggaucucggcuca

SEQ ID NO: 2245214 - RNA, 76 nt, Homo sapiens
ggucaaauauugagagugaaguuugcuaccuguaacuuaaaguaacauuuagagacauauuuuacucagauugacc

SEQ ID NO: 2245215 - RNA, 67 nt, Homo sapiens
uugacuagugcccucagaccuagaacacucuagcccauaauguucucuguucauggcacuaugucag

SEQ ID NO: 2245216 - RNA, 58 nt, Homo sapiens
ucccaccacuauuauaucacccucgguaaagaaccuucgagauguaguauggugugga

SEQ ID NO: 2245217 - RNA, 90 nt, Homo sapiens
uggcugggucaaauguauuucuaguucuagaucccugaggaaucgccacauugacuuccacagugguugaacuaguuuauagucccacca

SEQ ID NO: 2245218 - RNA, 62 nt, Homo sapiens
uggcucuuauauuuagguuuccgaaguuagaguuaauuuugguguauuguauaagguaguca

SEQ ID NO: 2245219 - RNA, 70 nt, Homo sapiens
ccuaaacaaauagagggauauaagcauauuuauacauugaguauguaggaugugucuuagucaauuuggg

SEQ ID NO: 2245220 - RNA, 130 nt, Homo sapiens
cccacccaccugccccagauguccugggcuuggggugccacgcuggcgucauggcuggcaucuuggcugguggcaccacagacgccaggcgugggucacagcgugagcccagccagcugguugggguggg

SEQ ID NO: 2245221 - RNA, 69 nt, Homo sapiens
gaugugcuccucucuguccugcuguauguucagguuuccuaguaucaagccacacauggucagcacauu

SEQ ID NO: 2245222 - RNA, 91 nt, Homo sapiens
caggguuuugcucuguugccuaggcuggagugcaguggcgugaucucugcucacugcagccucugccucucagguucaagcaauucuccug

SEQ ID NO: 2245223 - RNA, 68 nt, Homo sapiens
uagggauacauucugggaaguguguuguuaggugauuucaucauugcaaauaucguagagugucccug

SEQ ID NO: 2245224 - RNA, 66 nt, Homo sapiens
uguuuauuuauaccuggucucauuccacaagggauuuguggagugugauucaguauaauauaaaua

SEQ ID NO: 2245225 - RNA, 75 nt, Homo sapiens
ugagccaccaugcacagcugagaaaauucauuaaaagaaaaucuuuucaguaaucuuagcugugcagaggccuca

SEQ ID NO: 2245226 - RNA, 75 nt, Homo sapiens
gaacuauaguucccauaauccccacguauuguaggagggaaccagugggaugugacuggaucauggggacgguuc

SEQ ID NO: 2245227 - RNA, 129 nt, Homo sapiens
uuaaauuuaagggauguaagugcaguuuuguuacauggauauauugcuuagugaugaagucugggcuuuuagugcaaccaucaccugaauaauauacauuguacccuugcagauaacuuuuuuuuuuaa

SEQ ID NO: 2245228 - RNA, 55 nt, Homo sapiens
gugugggcauguguguguauacgcacagcugugcauguacacaguguacccacau

SEQ ID NO: 2245229 - RNA, 56 nt, Homo sapiens
cuuauaccaucaccauauuuagacuaggaaauaaaaugagauuggugugguauaag

SEQ ID NO: 2245230 - RNA, 89 nt, Homo sapiens
ggagaauugcuuaaacccaggaggcagaaguuguggugagccgagauuguaccaucgcacuccagccuggguaauaagagcaaaacucc

SEQ ID NO: 2245231 - RNA, 83 nt, Homo sapiens
uuuuucuagagagaagacuuaagcuuuuauguagucuuauuauuuuccuuuauuacuucugguuguguuuuccuuuagaagag

SEQ ID NO: 2245232 - RNA, 85 nt, Homo sapiens
agcucuagguagcauaggguuucauucuuuuccuccacuuuaauccagaggcagagcaaugacaugcuaugugguccaaaaagcu

SEQ ID NO: 2245233 - RNA, 55 nt, Homo sapiens
ucacaguaacuuuguugcuuuuuauaagaaugcauaggcaaugggguuguugugg

SEQ ID NO: 2245234 - RNA, 60 nt, Homo sapiens
auuuagggcaaggaacaguuaaaaagauuggaauucuuugacugcaucuuuacccuggau

SEQ ID NO: 2245235 - RNA, 59 nt, Homo sapiens
gucagaugcagauuccaguucuccaggucuggguggggcugggacucuguaagucugac

SEQ ID NO: 2245236 - RNA, 61 nt, Homo sapiens
guugccuaggcuggagugcagugacuauacugcauccaugaucuccuggccucaaagcaau

SEQ ID NO: 2245237 - RNA, 79 nt, Homo sapiens
uauauacacauaugcauguguguacaugugcacacacacacuguauguggacauguauauauauguguguguguauaua

SEQ ID NO: 2245238 - RNA, 68 nt, Homo sapiens
uaaauaguagcugaaugagggaacagaguugcaaauguuuucccuguuugucauuuaucuuuuguuua

SEQ ID NO: 2245239 - RNA, 129 nt, Homo sapiens
caggugugagccacggagcccagcccaaggccuggcuuuugauuuugcagaucuaaaaucuugauuugguucaugcaucuguagugguuaaguuugcuuguaacuuggcugggccguggcacacggcug

SEQ ID NO: 2245240 - RNA, 61 nt, Homo sapiens
uacagugcuuuuugguggagaaggggcaugugaucagugucucuguagagacagcacugug

SEQ ID NO: 2245241 - RNA, 92 nt, Homo sapiens
cuuccugcugacucaggaggcaggaauuucucugcagaccccaccagaagacuuugcagggcugcagggagagcuugcaggagaguaagaag

SEQ ID NO: 2245242 - RNA, 92 nt, Homo sapiens
auacuauagguuaagcacuuggcaaagugucuggcauuuaguaaauaauaaauguuagccauuauuguuaauuuguguuuaacaugaaguau

SEQ ID NO: 2245243 - RNA, 76 nt, Homo sapiens
uugcuugaacccaauagguggagguugcagugagcugagaucacaccauuguacuccagccugggugacagagcaa

SEQ ID NO: 2245244 - RNA, 58 nt, Homo sapiens
uauugugaaaguggccauagacaauauguaaaugaaaaaguguggcuguuuuccaaua

SEQ ID NO: 2245245 - RNA, 67 nt, Homo sapiens
ugucauuuaggcaaugcucucaaauuugguauaaucuuacuuaggccugaagcuuugccuagaaaca

SEQ ID NO: 2245246 - RNA, 67 nt, Homo sapiens
ucuccaccaggucccacccuugacacuuggugauuaugacaaugcaagaugagauuuuggauggaga

SEQ ID NO: 2245247 - RNA, 112 nt, Homo sapiens
aacaagauuacauaagagaaaagcaacagauuccacuuucaaauucaaauuccaaguuggaaagcugaauuugaaaguggaaucuguugcuuuccucuuaugugauauuguu

SEQ ID NO: 2245248 - RNA, 83 nt, Homo sapiens
uauuagguuggugcaaaaguaacugugguucuugccauuacuuucaauggcaaaucugcaauuacuuuugcuccaaccuaaua

SEQ ID NO: 2245249 - RNA, 55 nt, Homo sapiens
aagagugguuucaggucacuaagauauaaaaggaugggaugugagguacacucuu

SEQ ID NO: 2245250 - RNA, 91 nt, Homo sapiens
gagaggugagguaagagugucuuugugcuggccccaguuuuacccucuuuggggccaucaugaauacauuggguuccucuugugccugcuu

SEQ ID NO: 2245251 - RNA, 58 nt, Homo sapiens
ugguuauaguguaaucaugcuguaguuauaaaguaauacaguaguaauaguguagcca

SEQ ID NO: 2245252 - RNA, 90 nt, Homo sapiens
gaauuuuguauccugaagcuuuauuuaaguaaucuguuaguucuagaagcacuuugauggagucuuuaggguuuuccaaguaucgaauuc

SEQ ID NO: 2245253 - RNA, 55 nt, Homo sapiens
ugggaucuuuccuauuagcgagagccaaguccuggcuaauacuaggaagauuuua

SEQ ID NO: 2245254 - RNA, 71 nt, Homo sapiens
gccacauguucucccucaugugugggagccaaacaaguggaucucaugaagauagagaauagaucgguggu

SEQ ID NO: 2245255 - RNA, 94 nt, Homo sapiens
gaggacagccugugcuuaacagugaccccugguggccaugagaccugauggcuuuaguguagguuucuguuguuuggaaauaggacugauccuc

SEQ ID NO: 2245256 - RNA, 60 nt, Homo sapiens
gauauuggcaauccauauauuuucuuaauuucucgagagaaaauagacauugcuaguauu

SEQ ID NO: 2245257 - RNA, 71 nt, Homo sapiens
gcucccuaagaauucuguccgguauacuuuucaaacauuugaguaaauuaaagguaauuuuugggcugggc

SEQ ID NO: 2245258 - RNA, 63 nt, Homo sapiens
ggauguggcauucagugccucagggagccacuggagggauuugagcaagaggugacauuaucc

SEQ ID NO: 2245259 - RNA, 76 nt, Homo sapiens
agaggaaucaucacacugucuuucagaaugguugaacuaguuuacauucccaccaacaguguaaagguguuccuuu

SEQ ID NO: 2245260 - RNA, 55 nt, Homo sapiens
ccaaguguucucauuguucaauucccaccuaugagugagaacaugcagcauuugg

SEQ ID NO: 2245261 - RNA, 63 nt, Homo sapiens
uucuugcauuuuggagaaugcugaauuaaaauuguaggucagucuucuaaagggaugcaagga

SEQ ID NO: 2245262 - RNA, 94 nt, Homo sapiens
caugaggaaauagaaguugagagaguuuguaauuugcuccaugcuacacaguugguaacuggcauagccagacuucucacucauguuuucucug

SEQ ID NO: 2245263 - RNA, 76 nt, Homo sapiens
gaauaguacgugccuuguuguucauaugagauuauuacaccuacuuuucaguaugauuucaggguauauuuuauuc

SEQ ID NO: 2245264 - RNA, 105 nt, Homo sapiens
gcacaucauuucaucuaauguuuacacugauaaccugagacagaugaucugucucaggugaucugucucggguuaucaguguaaacauuagaugaaauaaugugc

SEQ ID NO: 2245265 - RNA, 61 nt, Homo sapiens
gagagggcgucuguauaggccuaggugaacuucaagauuuuagagcaacacacgcccucuc

SEQ ID NO: 2245266 - RNA, 81 nt, Homo sapiens
uucugcagguucacaguuaggacaacugcuucacacuuguuaaauguguuaaguugugguucuaaccaugugauaucagag

SEQ ID NO: 2245267 - RNA, 122 nt, Homo sapiens
gaauccuugucucucacauaggauuccagagcacugauacuggguucugaguguuuguccuucacauaggauuccagaacacugcuccgagagucugaauguuugucccucacauaggauuc

SEQ ID NO: 2245268 - RNA, 73 nt, Homo sapiens
gcaucacugggacuagagaugagauuuuucaaggcucucuucgugaaauauauuuuucugucugaguguaugu

SEQ ID NO: 2245269 - RNA, 65 nt, Homo sapiens
aaagucuuugucugguaaauccauccucugggucaucuugaggguggcauauauugauucucuuu

SEQ ID NO: 2245270 - RNA, 82 nt, Homo sapiens
cucugguucauaugccucugacaauuggauucuguauuuagauauaaaacccaaagacagaggucuaaauguguuucuugag

SEQ ID NO: 2245271 - RNA, 76 nt, Homo sapiens
uagauuuugcccaauuauuaagauauuaggguguuucauuaagaauggaagacucuagucucuugagcagagacua

SEQ ID NO: 2245272 - RNA, 55 nt, Homo sapiens
caagugaauaguugcucucagauaaauagaauauaggaaggcauggguuuacuug

SEQ ID NO: 2245273 - RNA, 73 nt, Homo sapiens
acgcugguggcuggacagaugggcucccgggucuagguugcccagcccagcccagccccucugucuccagcgu

SEQ ID NO: 2245274 - RNA, 55 nt, Homo sapiens
cauuugguguaguucucuguuguuguacccauaacauuguugauuauacuaagug

SEQ ID NO: 2245275 - RNA, 129 nt, Homo sapiens
aaauaagcuuccugacuucauaugucuacugugaauaaucagucacugcguuuuugggauuuugcuuuauaaucuuaacguauagcagugaacuccauguuuguggugugacaagaauaaaggauucuu

SEQ ID NO: 2245276 - RNA, 56 nt, Homo sapiens
uaaggcccggccuuuccaagcacuuauguaaagagcucuuggaaggaagggcuuug

SEQ ID NO: 2245277 - RNA, 67 nt, Homo sapiens
uggacaagauagguucuauauuugucaaaaaugugugcuccugacguuuauaccaaaucuuugucca

SEQ ID NO: 2245278 - RNA, 87 nt, Homo sapiens
ugucgaaguugcccaggauggcagugcagccccuggcugagguguagcagucauugauacuagccaucaugagcagcuucuuggaca

SEQ ID NO: 2245279 - RNA, 61 nt, Homo sapiens
aacuaaagcacugaauaaauuugcuugugcauauaagcaaaaagucaagguguuaaugguu

SEQ ID NO: 2245280 - RNA, 112 nt, Homo sapiens
acaagguugaacugagcuagaugagauucuucuuugguacaagggccgaccagguccucugggcucauacuacacaaagaaaaagaacauuucauaaaucagugcaccuugu

SEQ ID NO: 2245281 - RNA, 55 nt, Homo sapiens
auggcuuuguguucagagcugagagaucgaucaaagcaugaacucauugagcugu

SEQ ID NO: 2245282 - RNA, 68 nt, Homo sapiens
gguauugcuuuguugguuguauagccuuucuagaacucaauagguaauaagaugaaggaagccauauc

SEQ ID NO: 2245283 - RNA, 79 nt, Homo sapiens
gcguuuacuguguaccaggcacuugccuaggcucggaauauucacuggcccacaacagugccuaguauauaggaggcgc

SEQ ID NO: 2245284 - RNA, 67 nt, Homo sapiens
gcaugguguuaggcacugggaauggaauacugaacaaaucagagacauucuugccuucaccgagugc

SEQ ID NO: 2245285 - RNA, 81 nt, Homo sapiens
ggguauugauaguuaauugucugugaguaccugacagcaacggguuauggcuauugaugacaauugguaccuucagugccc

SEQ ID NO: 2245286 - RNA, 65 nt, Homo sapiens
uuugguaguuuguugggacccaugggugggcaugggaagcugacauuuccaaaggaacuaccaag

SEQ ID NO: 2245287 - RNA, 79 nt, Homo sapiens
agcugcaggugcauuguuuagaaacacuggguucugagaguuccagcccugcugauuuugagauaauguauugccagcu

SEQ ID NO: 2245288 - RNA, 74 nt, Homo sapiens
guuuucuccaccucuuugauguucugaaagaugggcacuguaaugucauauuaccaaacacagagaaagagaac

SEQ ID NO: 2245289 - RNA, 80 nt, Homo sapiens
uucaguggcacaauugcagcaauaaacaaagacagaugacaauucagcuuagauguuucugcugcagucuugguccugaa

SEQ ID NO: 2245290 - RNA, 55 nt, Homo sapiens
uagauuaucuaugaggcuuccaugcuauaacaucagagguaacagagauagucua

SEQ ID NO: 2245291 - RNA, 58 nt, Homo sapiens
caugugcacaacaugcagguuuguuacauauguauagaugugccauguuggugugcug

SEQ ID NO: 2245292 - RNA, 59 nt, Homo sapiens
ucuuuuaaggcaggucugguggugacaaaaugucucagcauuugcuugucuguaaagga

SEQ ID NO: 2245293 - RNA, 58 nt, Homo sapiens
ugagaugaaagcagaaagacuucaguguacauuuauugagucugacauuuuucucuca

SEQ ID NO: 2245294 - RNA, 70 nt, Homo sapiens
uuuuucuggaugugcagcauagauaagguggcaacaggacgccauguauacaugugggcaucaggagaga

SEQ ID NO: 2245295 - RNA, 59 nt, Homo sapiens
cucaacuuacuguguucauuggguaaaccaaccauucugauaacacaguuguguuugag

SEQ ID NO: 2245296 - RNA, 102 nt, Homo sapiens
ggcccucuugaucugaggcggggagacacagggauggguaggaccauggggguugaaccuuccuugcacuccacuguucuccuggcuuccaaagaacuggcu

SEQ ID NO: 2245297 - RNA, 94 nt, Homo sapiens
gacuggcuuuuucauuaaguagaugaaugugaauguuucuugacagcaaggacaauguuuccauguucaauuuacuaugaaaagaacgccaguc

SEQ ID NO: 2245298 - RNA, 84 nt, Homo sapiens
ggaaaaguauuguucuaauaucugguacauauauaaaaccucuaguauugccuaacauagauguucagaauaugacccuuuucu

SEQ ID NO: 2245299 - RNA, 60 nt, Homo sapiens
cuuuauucaggaccauuguuaauagguacagaaccauugcaaugaggucuugcaguaagg

SEQ ID NO: 2245300 - RNA, 96 nt, Homo sapiens
gagaggagaauugcuuaaacccggagucggagguugcagugagccaagaucgcaccauugcacuccagccugggcgacagagcaagacucugucuc

SEQ ID NO: 2245301 - RNA, 129 nt, Homo sapiens
uuugcaauaacaucuauggaccuugaggacuuuaugcuaagugaaauaagccagucauagagaaaaauacacugcauaauuccacuuauaugagguaucuaauauaguuaaauuuauagagucaaagaa

SEQ ID NO: 2245302 - RNA, 74 nt, Homo sapiens
ugggggucacucuagcaucagggugguauucauagaaggguggguaauaccuuccccugcuggagaggcucuug

SEQ ID NO: 2245303 - RNA, 68 nt, Homo sapiens
ucacuugagcugaggaguuugagacugcagugagcuaugaucacaccacuguauuccagccugaguga

SEQ ID NO: 2245304 - RNA, 56 nt, Homo sapiens
gucaguggugacuuccauccaaucacaaaggccugaaugcuggagucauccuugac

SEQ ID NO: 2245305 - RNA, 71 nt, Homo sapiens
gacccacuggccauuuugcccaggaccgagguacuuucagagcugacaucuggcaaaaugggcaguggguu

SEQ ID NO: 2245306 - RNA, 62 nt, Homo sapiens
ccucucagguccuuacugugcucccuccgcagaugagaaggagacgccagggccuggggagg

SEQ ID NO: 2245307 - RNA, 56 nt, Homo sapiens
ugaauguaagaugucugcuggucaucaguuacauaaucagcaaauauaaacauuca

SEQ ID NO: 2245308 - RNA, 60 nt, Homo sapiens
ggcaugauggcugaggcuucugcagcuauuuugugaucuugaggcuucaggccacaugcu

SEQ ID NO: 2245309 - RNA, 96 nt, Homo sapiens
ccuuuuggaaugggacugugaaucauaugccagucaugcuauugucauuuggaagcagauagcuuaugugguuucacagauucacagguggagagg

SEQ ID NO: 2245310 - RNA, 56 nt, Homo sapiens
ucugauuaagguaaccuggccuugguccaccacuuuacuaaguccccuugauuaga

SEQ ID NO: 2245311 - RNA, 83 nt, Homo sapiens
ucccgcgccugaucacuaacggugggaggccugggccuucuggagaaaagaggcuagaaucuuccaucuuggguugugcggga

SEQ ID NO: 2245312 - RNA, 103 nt, Homo sapiens
uuagggcauuuucauauauucuugugauuauaaaguaguauguucaaguuuuaguaaauuaauauuacguuaucagguaugcaagaggagugagaaccacuaa

SEQ ID NO: 2245313 - RNA, 118 nt, Homo sapiens
gauacauaauauuguagauauuaaugggguaugcauaauauuguuacaugcauagaauguuaaugaucaaguaacaguauaugugguaucuaucuaucuaucuaucuaucuauguauu

SEQ ID NO: 2245314 - RNA, 84 nt, Homo sapiens
uugccuucuaaguacugucagaauuggacugguaccuagcaaaaauaucaaaauuaugaguccuagaacagugcuuggauguaa

SEQ ID NO: 2245315 - RNA, 130 nt, Homo sapiens
aaagauauuacugccaauauccuaggggcuguauaccccuccugugauauuguuucuaauauccaguggagaccaggaugauauuacuuccaauauugcaagggauguacagccucgcugugauauuuuu

SEQ ID NO: 2245316 - RNA, 130 nt, Homo sapiens
caaaggcaacggauacugcugaggcuccugagaaugucccguuuucgaggcugcaguagcuccgguguccgguucugcagugccgagagggaggccucgggcuccgggcgggggaauguguugcaguuug

SEQ ID NO: 2245317 - RNA, 69 nt, Homo sapiens
ugcacuuuggagacguuuaaagagaacuguuaggauuuuucauuuccuuuggcuaacuuucuaagugca

SEQ ID NO: 2245318 - RNA, 69 nt, Homo sapiens
aaauugagacucuuagauuggaaaucugaauuuauuuacacgauugagauugaucuagaguuuuauuuu

SEQ ID NO: 2245319 - RNA, 67 nt, Homo sapiens
gguggaguuugacaugccuuugggauacuguaugaguuuccuagggcuguguguacaaauuaccauu

SEQ ID NO: 2245320 - RNA, 64 nt, Homo sapiens
auggcauuuuuggcauuuaaauaugcauggauauauuuauuuauguauaugugguguuggccau

SEQ ID NO: 2245321 - RNA, 76 nt, Homo sapiens
gaucauaugaugugugcauuuaacuuuaugaaaaacuaccaaauuuuuuuucagagugguuguaccauuugagauu

SEQ ID NO: 2245322 - RNA, 67 nt, Homo sapiens
cguguggucaguguuaucaccgaaggaaaauguggugcuuuuccuuggguggacgcugaucaauaug

SEQ ID NO: 2245323 - RNA, 113 nt, Homo sapiens
gccgaaagccaaguucagaaagugucuuaccgggagggaguccuguccuccaccauauuugccaggacaucacucccuccuccucaagacacuuccugaaccgggcuuuuggc

SEQ ID NO: 2245324 - RNA, 56 nt, Homo sapiens
gaggacaugugauaugcugcuggcuggcuggggcugugcagaugccacagucacuc

SEQ ID NO: 2245325 - RNA, 130 nt, Homo sapiens
acuccugggcucaagcaaucugcccacguaggccucucaaagugcugggacuggcugggugcgauggcucacgccuguuaucuuaucacuuugggaggucgaggugggaggaucuuuagaggcaaggagu

SEQ ID NO: 2245326 - RNA, 58 nt, Homo sapiens
uugcuaaaguuugugauuugauuugcaccuauuaguaguuuaucacaaacucuagcag

SEQ ID NO: 2245327 - RNA, 73 nt, Homo sapiens
gacaugagauuugggaggggccaggggcagaauaauaggguuuggauuugugucccugcccaaaucucauguc

SEQ ID NO: 2245328 - RNA, 127 nt, Homo sapiens
gcuuucuucugucuuaauguuagcucugucuuucaaaaggguguuugccugacaugugguugagcugcuggucagcagcacaucccuuucuggccuaggguaggggagcaaagaggcagaggaaagc

SEQ ID NO: 2245329 - RNA, 60 nt, Homo sapiens
uuaugguaaucucggcuuuuuuggucuaguagauuuuagaugaguugggguuuacuguaa

SEQ ID NO: 2245330 - RNA, 65 nt, Homo sapiens
cuccaggacacugauguaugcugugggcuggugcagcccagggcacagcagucaguuccauggag

SEQ ID NO: 2245331 - RNA, 76 nt, Homo sapiens
aaauauguacagauauguguguacaguuguuuuauauaacauuuuauacaaaugacauguauaucuuacgcuauuu

SEQ ID NO: 2245332 - RNA, 98 nt, Homo sapiens
acauuauaucucuuuuagggucaggucuucauuugacuuacugaccauuaugacucaguaagucaagugaagaccugacucuuaaagggauauaaugu

SEQ ID NO: 2245333 - RNA, 88 nt, Homo sapiens
gguuaacaucuucaucugguuugugaacuuuuuacugcuuaggaaaucuuaagauacaaagggcauaugaucagggggauguauagcc

SEQ ID NO: 2245334 - RNA, 57 nt, Homo sapiens
cuauuugcaaagcacuaagaacaguguccggcacagagucagugcuauguaauguag

SEQ ID NO: 2245335 - RNA, 72 nt, Homo sapiens
cuaucuuauucuccucaacugugaaacgggugaauguucaucucacaggguuauugagggggauugaauuag

SEQ ID NO: 2245336 - RNA, 55 nt, Homo sapiens
auuacuguggcuccugggaauacugaaucugugaaauccaugagcccacagugau

SEQ ID NO: 2245337 - RNA, 58 nt, Homo sapiens
agagucuaguauuaaaaucacacuguguaguuuaauuccacuuuaaugcuaggacucu

SEQ ID NO: 2245338 - RNA, 76 nt, Homo sapiens
ucauugugagagcaucauucaacaaaagucuugcaugucuugucaagacuugaccuugugagcguuuugcaaauga

SEQ ID NO: 2245339 - RNA, 76 nt, Homo sapiens
ugaauaggacugagagucacagugaauguggcaugcaugccugugucaugugacauaugugagucucggcauguca

SEQ ID NO: 2245340 - RNA, 64 nt, Homo sapiens
acugugaauagugcugcaauaaacauacgugugcaugugucuuuauagcaguaugauuuguagu

SEQ ID NO: 2245341 - RNA, 72 nt, Homo sapiens
agggcucuagcauuucugggaugauaaacaaacaacagcuuuaauuuaaagucaccagcuguguuagccccu

SEQ ID NO: 2245342 - RNA, 57 nt, Homo sapiens
gacuuaaucaucauuuaaaggcccaaccuguaaagcuaucacauuggugauuaaguu

SEQ ID NO: 2245343 - RNA, 86 nt, Homo sapiens
agccaaacagaggaguuggauccagagucuucuguugaaaacuggaagcuagaaugucagcuggauucagcucccucuacguggcu

SEQ ID NO: 2245344 - RNA, 70 nt, Homo sapiens
ucauaaaagauaaugagauccagucauuuguaacaacacagauggaacuggagaucauuauguuaaguga

SEQ ID NO: 2245345 - RNA, 89 nt, Homo sapiens
cuugugucauucgauuuuauggccccuacaugugcaaaauucacagcuauuguugccaggaagaggccacaucgaguagauugaccagg

SEQ ID NO: 2245346 - RNA, 62 nt, Homo sapiens
uccuagcugcauccugugcacucaaggucccuaaggaaauugacggggaagugaggcugggg

SEQ ID NO: 2245347 - RNA, 63 nt, Homo sapiens
uggccuauaaggguucugcugagaagucugccguuaggcuuauuaagauucccuuauauguua

SEQ ID NO: 2245348 - RNA, 60 nt, Homo sapiens
cacccuugcauguggaugcccucucauucuguuuggauacugacaucccaugcuggggug

SEQ ID NO: 2245349 - RNA, 78 nt, Homo sapiens
uuuucuugggugaguuugugaauaaauuaaguugcuuuuuaaucuguugcuuuuaauugcaaauacaucccaggagaa

SEQ ID NO: 2245350 - RNA, 62 nt, Homo sapiens
uucaguaauacugucaguuuggcuuuuuuuguaggucaacuuauugaacucaguauucugaa

SEQ ID NO: 2245351 - RNA, 71 nt, Homo sapiens
gacgugaguuuugggggggcugguaaaagaaugcuaugguuugaguauuuguccccuccaaaagucauguu

SEQ ID NO: 2245352 - RNA, 72 nt, Homo sapiens
uaggguaguacagagaguguccuaaagggccaagcacacaggugagauuaugacacuccugugcgcacccug

SEQ ID NO: 2245353 - RNA, 124 nt, Homo sapiens
uucuguucagaaaggaggaaggguacugaacacaucuuugguuagaggauaagcacauccugaaauuuucuugagaacuaaggauuugugaguugaauaacguuuuuuuuuuuuugagacagag

SEQ ID NO: 2245354 - RNA, 55 nt, Homo sapiens
agcuaaugggagacccuuucacugcauuaguuuugacagaggucuuuuaauagcu

SEQ ID NO: 2245355 - RNA, 83 nt, Homo sapiens
ugcaauaguuuacugagaaugaugauuuccaauuucauccaugucccuacaaaggacaugaacucaucauuuuuauggcugca

SEQ ID NO: 2245356 - RNA, 86 nt, Homo sapiens
uuuauuuguaaagguuauuaacuugacccugaaaucuacaaacuguuccauucaguaguaaguuggaacucuauuuauguaguaaa

SEQ ID NO: 2245357 - RNA, 69 nt, Homo sapiens
uuguucuauuuucuucccacucuccaaagaguuuggcucccuuugaguaguaagaagaugauagaaugg

SEQ ID NO: 2245358 - RNA, 55 nt, Homo sapiens
uugagauggagucuugcucugucgcccaggcuguagugcaguggcaccaucuugg

SEQ ID NO: 2245359 - RNA, 65 nt, Homo sapiens
ggguuauuggaacuguucguauugaaaucacguagaucuucuugcccuacgguucccuagaaccc

SEQ ID NO: 2245360 - RNA, 66 nt, Homo sapiens
ccagaggucucuccaucuggacuaggcggccggucaggcucuucuuccagccuugaggggcccugg

SEQ ID NO: 2245361 - RNA, 82 nt, Homo sapiens
acaugggcauccaagagacugaugacuuccggggcuggcuccauucaggcagguagaucagucucuuuaugaauaccugugu

SEQ ID NO: 2245362 - RNA, 63 nt, Homo sapiens
ugacuugaacuucuaugucaccuuuugggcaagaacaccugagugcuuagaguuucaagauca

SEQ ID NO: 2245363 - RNA, 73 nt, Homo sapiens
ggguaaugaguauguucuguauuuucacugugauauuaauuucacugguauauacauaugucaaaauuuaccc

SEQ ID NO: 2245364 - RNA, 71 nt, Homo sapiens
uguugucaaaauaaacuucuaaauugauugagacuugucucagcuaguuuuugguuuacaguuacauagca

SEQ ID NO: 2245365 - RNA, 68 nt, Homo sapiens
ucacauggacacugguggauauggaauggcuuuuuucugcgcaauucacauccgaccaggucaaguga

SEQ ID NO: 2245366 - RNA, 80 nt, Homo sapiens
ugacaagccacucccagugcaaagccucugcccagaaccucuucuccuaggcucuuggcauggcuuaugccuucuuguca

SEQ ID NO: 2245367 - RNA, 71 nt, Homo sapiens
auggcaaggugaugaaugucuacaaauaccgcaaaugggugaagaauugagaccauaucucauucugucau

SEQ ID NO: 2245368 - RNA, 58 nt, Homo sapiens
gcccaagaguuugaggcugcagugagcuaugauuaagccauugcacuccaaccugggu

SEQ ID NO: 2245369 - RNA, 79 nt, Homo sapiens
uuagguuggugcguaaguaauugagguuuuugcuguuacuuuaguagcaaaaaacacaauuacuuuugcaccaaccuaa

SEQ ID NO: 2245370 - RNA, 78 nt, Homo sapiens
gcucaugccuguaaucucagcauuuugggcugaggcgggaggaucacuugagcucaggaguuugagaccagccugggc

SEQ ID NO: 2245371 - RNA, 75 nt, Homo sapiens
uuguuaucuggcuguguguuaaaauaggcuucauaaugaguuagaugucaaacuuauacacagaggggauagcaa

SEQ ID NO: 2245372 - RNA, 57 nt, Homo sapiens
uuguguguguggugugugugugugugucugugugcauacguacauaugcacauaugg

SEQ ID NO: 2245373 - RNA, 90 nt, Homo sapiens
ugcaugaggaggauuucagggagaaggcaaacguugagcugauaacugagacaauggaugucauucaucuguggauuguuaacaagugca

SEQ ID NO: 2245374 - RNA, 71 nt, Homo sapiens
ggauuugguuugccaguauuuuauugaggauuuucgcauagauguucauuagggauauuggucuaaaauuc

SEQ ID NO: 2245375 - RNA, 75 nt, Homo sapiens
gaaacagauugcugagccccacccucaggaaguccgaucuaggagauuuggguggggcuugagaaucugcauuuc

SEQ ID NO: 2245376 - RNA, 58 nt, Homo sapiens
cugcagguucaaggcaaaggaagaugauugacuucuuaauucuuuggcugaacuguag

SEQ ID NO: 2245377 - RNA, 64 nt, Homo sapiens
uuuugcauuggcugaggaguguuuccuuccaauuauguggucacuuucuagaauaagugcaaag

SEQ ID NO: 2245378 - RNA, 120 nt, Homo sapiens
aggaagaguagcugaauacagguagggugacauuauguucgauuccuuuaaaagacauuugagagcugagaagguaguuagaaaauauaacucaucccuaccccugucaccuaccuuucu

SEQ ID NO: 2245379 - RNA, 129 nt, Homo sapiens
uguuuguguauugugugauguguccaccugcacuggcauacuacacauguauauggaagacuguauuagcauguucguguaugugagaaugcucaugugugggugaaugcaagaguauguguguaagca

SEQ ID NO: 2245380 - RNA, 101 nt, Homo sapiens
ugaaugucuuuauuucuuuuucuuauaugauuaaacuugccagaaccaugagcacaaucuugaaucaaaguggcaaguuucaauccgagggaaaacauuca

SEQ ID NO: 2245381 - RNA, 87 nt, Homo sapiens
gcuuuuaaccuacuagaggagguagucauauguauuaauuauuuauugcuauguaacacauuaccuuuagacuaagugguuuaaagc

SEQ ID NO: 2245382 - RNA, 65 nt, Homo sapiens
cugcaaccuaauccccuuugccuuguaaucugacauagacacagguacaagggauuaggaugugg

SEQ ID NO: 2245383 - RNA, 103 nt, Homo sapiens
uguaugaguauaucacuggcagugcuuguuauccuggcuuucaaacaagucuggaaagacuccaggguaaagcacagcauaccaggaucuuuugcucaauaca

SEQ ID NO: 2245384 - RNA, 57 nt, Homo sapiens
ugaaaugguuaugugaggagauuggcagauccuuuucucaaugaaacaaccauuuca

SEQ ID NO: 2245385 - RNA, 88 nt, Homo sapiens
ggccugcagcaacucuccuagcagggcccugguacagccaacuggaagcuuuguauugcucugacugauuggaugauuugcugagguc

SEQ ID NO: 2245386 - RNA, 97 nt, Homo sapiens
ugguggcaugccuguagucccagcugcuuaggagccugaggcaggaggacugccugagcccagcccuguaguucaaggcugcagugagcugugauca

SEQ ID NO: 2245387 - RNA, 80 nt, Homo sapiens
uuugccaaagugauacagccagugaguaaaggagcuggaauuugaacccaacuguuagagcugguaaucacuuugccaaa

SEQ ID NO: 2245388 - RNA, 110 nt, Homo sapiens
gacccaucaguccugcuggaccaucugugagacugguucugaacccagugaccucugucucuggggacaguuccaucuccaguggucuccaccacaggcuggacaggguu

SEQ ID NO: 2245389 - RNA, 55 nt, Homo sapiens
gugggcaaagcuaguguguagaguaugucauuugugugcacacaugcaugcccgc

SEQ ID NO: 2245390 - RNA, 90 nt, Homo sapiens
cugucuuagaugugaguccuggagugucaguuuccagaguuuauacccuuagacuuugcugugggcacuucuacucacuaacugggauag

SEQ ID NO: 2245391 - RNA, 64 nt, Homo sapiens
gccagaagucaaggcauuuccagcagcccccaugcccuacuggaggugucuuggguucccuggc

SEQ ID NO: 2245392 - RNA, 76 nt, Homo sapiens
ccagcaagagagguuacagucuuguguaagguuauaacagaggugaugacccgucauccuggcuguauuuuguugg

SEQ ID NO: 2245393 - RNA, 58 nt, Homo sapiens
agcuacguuggggaaguucucaugaaugacauccugaaacauguuuuccaacuugguu

SEQ ID NO: 2245394 - RNA, 88 nt, Homo sapiens
augccacaguuuauuucuccauuuaccuacacaugggcauuuggguuguuuuucauuuuggguaauggagaaauaaaucugcugacau

SEQ ID NO: 2245395 - RNA, 108 nt, Homo sapiens
gcuuuuugacgugcugcuggauucgguuugccaguauuuuauugaggauuuuugcaucgauguucaucagggauauuggccugaaauuuuuuguuguugugucucugc

SEQ ID NO: 2245396 - RNA, 87 nt, Homo sapiens
cuguguaguuugcugagaauggugguuuccagcuucauccaugucccugcaaaugacaugaacucauccuuucuuauggcugcauag

SEQ ID NO: 2245397 - RNA, 87 nt, Homo sapiens
uguggaacuuguugggaauuggaguaaagaucacucuugcuaugcaaagacacuggcaccauuuuacuccuucccuagagauccaua

SEQ ID NO: 2245398 - RNA, 129 nt, Homo sapiens
agaaauaaacaguaaguacaaguuaaugguugucuugagagaggacaugacugaggagaaauacacaaguauuaguuaaggucuguuucuuaagaugaguaguggaccuauauugucuguuuuaguuuu

SEQ ID NO: 2245399 - RNA, 64 nt, Homo sapiens
agagcauguagaauacuuuaggcacuuacaauuuauuuucuuucuaaaguacucugaugccucu

SEQ ID NO: 2245400 - RNA, 89 nt, Homo sapiens
gagaggaugcaggugacuuuucugagacaaugcuuugcagcuuguaugagauucuuagagaagucugguccucccugccccagccucuc

SEQ ID NO: 2245401 - RNA, 68 nt, Homo sapiens
cauaaaauaaaaugagauccagucauuugcaacaacaugaauggaacuggagaucauuauguuaagug

SEQ ID NO: 2245402 - RNA, 63 nt, Homo sapiens
auaacuaggaaaccacauaacaaguuuuaaaggacacauuugguuaugucguuucuugcuuau

SEQ ID NO: 2245403 - RNA, 55 nt, Homo sapiens
gcuucucuaguugccuggagcauaguaauaugauuuuccagcacauuagggaagc

SEQ ID NO: 2245404 - RNA, 59 nt, Homo sapiens
gugucuuaguccacuggaacuguuauaacaaaauauuauagacugggugggcuaaacac

SEQ ID NO: 2245405 - RNA, 58 nt, Homo sapiens
aacaccgagauuaaauguaagcuguuacuuauuaucaagcuugcaucauuuuguuguu

SEQ ID NO: 2245406 - RNA, 66 nt, Homo sapiens
ccggcagcaguguuguggagucuauugugagggacaaacucucagaaccuccuagcaguguucugg

SEQ ID NO: 2245407 - RNA, 85 nt, Homo sapiens
aucuacauuacaugugaguauuuaauacauuuuuaauaguauaaaaaguaaaaugaugagaugaugagauguucacaguguggau

SEQ ID NO: 2245408 - RNA, 76 nt, Homo sapiens
gagaguucuguagauaucuaucaggucaauuugcucuagugcugauuucagauccugaauaucuuaguuaauuuuc

SEQ ID NO: 2245409 - RNA, 107 nt, Homo sapiens
cauggcuuguaucucugccaaccaagccaugaccacagguguugguuugauugcuucuggccagugugaugugaucauggcagguggugucgaguugauguuccaug

SEQ ID NO: 2245410 - RNA, 60 nt, Homo sapiens
cugaaggggagguuagaguacgaagagcauucacgcuacugucuagaccucauccuacag

SEQ ID NO: 2245411 - RNA, 64 nt, Homo sapiens
ugacccaguuauucaacuuccucaguuaacagcaaagaggcaugagaggugaauggcaggcuca

SEQ ID NO: 2245412 - RNA, 87 nt, Homo sapiens
gguccaguccuggcauggaguggauggccccagagagcggagaggaccccgugccuggggccaucucacccacuguugagacaggcc

SEQ ID NO: 2245413 - RNA, 72 nt, Homo sapiens
ggacaugaguauuugggggaccagagaauggacuguuauggguauaauuuugucucuccaaaauucaugucc

SEQ ID NO: 2245414 - RNA, 81 nt, Homo sapiens
uggauacaugagaugguugaccagagagcacacgcuuuauuugugccguuugugaccugguccacuaacccucaguaucua

SEQ ID NO: 2245415 - RNA, 115 nt, Homo sapiens
cagagcaaggccagggucagccugagacauuaagacacauaagcagaagaacaaagacaaguucucuggauauuccugucuaaaaaucccacugauacucuggugagauggucug

SEQ ID NO: 2245416 - RNA, 65 nt, Homo sapiens
gcuguuuggagaugcagcaagaaaggccacuaacgaggccagauuguaacaguucugcgagcagc

SEQ ID NO: 2245417 - RNA, 58 nt, Homo sapiens
acuggcauggcaccauagugagaggaaggggguucuuucuugggcaugcuaugucagu

SEQ ID NO: 2245418 - RNA, 56 nt, Homo sapiens
uugagacggaguuuugcucuuguugcccaggcuggagugcaauggcuccaucucag

SEQ ID NO: 2245419 - RNA, 92 nt, Homo sapiens
ugcucccaagaugacaucacacaguugccuaucuccugaagugcaaaaaagguuuuuaaggaaauaaggcaauuuugaagagguuaggagca

SEQ ID NO: 2245420 - RNA, 75 nt, Homo sapiens
aauuguuuauuuguuuuucacauuuauuugaucuuauuuacuagauuauauguuucuuagggacagaggacaauu

SEQ ID NO: 2245421 - RNA, 59 nt, Homo sapiens
uuaggauacggagaccuuaaggaaacaagccuucccccugcaaggugcuucuguucuga

SEQ ID NO: 2245422 - RNA, 64 nt, Homo sapiens
gucauaccuucaagugauggccacaaaacucaaaagguuuguggucaucacuugaagguaagac

SEQ ID NO: 2245423 - RNA, 123 nt, Homo sapiens
cuguucacaccuaaugucuugaagaguagguagcagcagugugggcugaaccuaggccagcuugcuuagcgggucacccugcugugaaguccuggcagguguugguaauguguggaaaugcag

SEQ ID NO: 2245424 - RNA, 63 nt, Homo sapiens
uuuccuuuggguauucucccuuggggcuaaugaguuccauuaggcuuauuacccaaugugaga

SEQ ID NO: 2245425 - RNA, 58 nt, Homo sapiens
acccaggaggcggagauuacagugagcugagaucgcaccauugcacuccagcaugggu

SEQ ID NO: 2245426 - RNA, 98 nt, Homo sapiens
ggcaagagaaucauuugaacccggaaggcagagguuguagugagcugagaucacaccacugcacuccagccugcugggugacagagugagacucuguc

SEQ ID NO: 2245427 - RNA, 59 nt, Homo sapiens
aggaagacuggcuuguuuacccaaccaaccaguuguugaaggaaaacaucagucuuuuu

SEQ ID NO: 2245428 - RNA, 129 nt, Homo sapiens
guauacuugaaauaugcuaagggaauauaucuuaaguguucucaccgcagaaacaaggauaaaaacaagaaauuacuuugugaggugauggauaugucuugauuuugguaauuauuucacauuguguac

SEQ ID NO: 2245429 - RNA, 62 nt, Homo sapiens
ucccuccuucuuuagucggucucaauuauuccaaagaauccuugaguugaagcaaggaggga

SEQ ID NO: 2245430 - RNA, 66 nt, Homo sapiens
guauuucuaguucuagaucccugaggaguugccacaccgacuuccacagugguugaacuaguuuac

SEQ ID NO: 2245431 - RNA, 60 nt, Homo sapiens
cauuuauggaagagacugcuuuucccacaaucuauguucuuggcaccuuuuccaaaaaug

SEQ ID NO: 2245432 - RNA, 129 nt, Homo sapiens
aaagauccugccuuugcucugcgcaguuucaaaguguucacugugaacucauauucagacucuagcauuuucuucugaauauccucacuggugauaaaucuuuggccuuugaaaguggaugugauuuuu

SEQ ID NO: 2245433 - RNA, 69 nt, Homo sapiens
agccugcagugucuaccaucaugcacuucucaggggaacacuuugagaguggcagagguggaacuggcu

SEQ ID NO: 2245434 - RNA, 64 nt, Homo sapiens
gccuuuguucuucguuccugagccaucugguugcaaaguaugguaggagcacagugcagcaggc

SEQ ID NO: 2245435 - RNA, 63 nt, Homo sapiens
guacugcaagaaaugacagugcagauaucuguucaauauucugauugacauucuuuggaguau

SEQ ID NO: 2245436 - RNA, 129 nt, Homo sapiens
ugggacuacaagccugagacacugugcuuagccaacucaccaugucuuuuaaacauucaacuuucaguuaaagggaacacucaagacauguuaugaggcugggcauaguggcucacgccuguaauccca

SEQ ID NO: 2245437 - RNA, 85 nt, Homo sapiens
gcucaucaauauucuugcaauuuuauuuacauggggauucuagaacacuaauaucuguguauagaugggggauagggaagugagu

SEQ ID NO: 2245438 - RNA, 77 nt, Homo sapiens
guguguugucuuucauuuagucccuccaguuuggguuucucuuguaggacuagggacauggggagcugauaccauac

SEQ ID NO: 2245439 - RNA, 84 nt, Homo sapiens
ccaacaauauauaagcugaugagccacaaugauauauaaaaccugucaaccaaguauuugugaaucagcuguauagauuguugg

SEQ ID NO: 2245440 - RNA, 93 nt, Homo sapiens
uguaccaccauauuuguugcagcauuauucacaauugccaagauauaaaaaaccuaaauguuaguggaugcugaauaaagaaaagcugguaua

SEQ ID NO: 2245441 - RNA, 56 nt, Homo sapiens
gcagggcaguguggguuggagggggucuuccucucucugagccauggcugcccugu

SEQ ID NO: 2245442 - RNA, 97 nt, Homo sapiens
cugguuuaauauuccuggaauauuaaauguuuggcuggagaugaucaaguugccaagauugguuuaauauuccuggaaggaugaagaaaggaauuag

SEQ ID NO: 2245443 - RNA, 79 nt, Homo sapiens
uagguuguugcaaaguaauugugguuuuugccauaaagagguaaauggcaaaaaccgcaauuacuuuugcacuaaccua

SEQ ID NO: 2245444 - RNA, 69 nt, Homo sapiens
ugugaugugcauguguaugugcaugugauguuguauguucaucauguguucaucacagcacaauucaca

SEQ ID NO: 2245445 - RNA, 62 nt, Homo sapiens
gucugcugccuuuuguucagauaugcccugccccagagguggaaucuagagaggcaguaggc

SEQ ID NO: 2245446 - RNA, 130 nt, Homo sapiens
ugcguuaaggaacuguugaaggaaaaaagaaagaaacacuaugagaaaaggaugccaauuaauuuaguuguugauugauguccaucucuagguaaaucuacuuaguaacuguacagcuucuggaaacgua

SEQ ID NO: 2245447 - RNA, 55 nt, Homo sapiens
cuuggagaugagcaggauguggagguagcccucgaucaccgugcaguucuccagg

SEQ ID NO: 2245448 - RNA, 106 nt, Homo sapiens
gacaaggaacaaauucucccucggaggcuccagaagaaaccaaccaugccaacaccuugauuuuggucuucuggccuccagaaccgggagagaauauauuucuguu

SEQ ID NO: 2245449 - RNA, 82 nt, Homo sapiens
gcucaggccuguaauuuuagaauuuugggaggguuaggcaggaggauugcuugagcacaggaguuuugagaccagccugggc

SEQ ID NO: 2245450 - RNA, 74 nt, Homo sapiens
acagguguauucuuugucacuaaauuuuuuuaaauaaaucauuuauuugguugggugcgguggcuuacgccugu

SEQ ID NO: 2245451 - RNA, 77 nt, Homo sapiens
agacucaggaaaauauaguaguugucuucaucugaauggcuaucaugaggaagacugaaauugcuguuccucagucu

SEQ ID NO: 2245452 - RNA, 60 nt, Homo sapiens
acaguugaggugaaguaauauucuaaguaccaugacuugaucauugcucacuuuaucugu

SEQ ID NO: 2245453 - RNA, 62 nt, Homo sapiens
auuaacuuacugggugucucagguagcaaaauggaaacaauacuggccccaaaguagguagu

SEQ ID NO: 2245454 - RNA, 89 nt, Homo sapiens
cauauuuugagaucagguagugugaugcuccuguuuucucuuuauaccuugaagucucaagacagugggcgucacauacaaaaauuaug

SEQ ID NO: 2245455 - RNA, 117 nt, Homo sapiens
ccugccccuguucucccccauuccccuagagcuacagcccucacugucccgugaggggaaaaggcauggugacaaugggggcuguagcccuaggagaacggggggaagaugggcagg

SEQ ID NO: 2245456 - RNA, 68 nt, Homo sapiens
guugaaucaugaaauugccauuuuugaggguuaaaacagucggguuuugucaguuuccagaguucaac

SEQ ID NO: 2245457 - RNA, 67 nt, Homo sapiens
gcauggaugugaaaucauaguuucuaguaagacacagaaacguguaugugauauucacauagguugc

SEQ ID NO: 2245458 - RNA, 57 nt, Homo sapiens
uguuuagaaaacaaaucaagagcuuuaucaacugccuugacacugguuuucugaaua

SEQ ID NO: 2245459 - RNA, 78 nt, Homo sapiens
ccagguucuuuucaccuugagauguugcucugaaacaaggggccuccaaagcuccugcagcaggggaagagagccugg

SEQ ID NO: 2245460 - RNA, 70 nt, Homo sapiens
uguuguaaaauucuguuucauucuguuuuaugcuacuguaacaauaucugagacggaguuauuuauaaua

SEQ ID NO: 2245461 - RNA, 83 nt, Homo sapiens
uugcuauuagguuggugcaaaaguacucgugguuuuugccauuaaaaguuauggcaguuacuuuuccaccaaccuaauaauaa

SEQ ID NO: 2245462 - RNA, 127 nt, Homo sapiens
agccuugucugucucuucccgccaguggacaucauuuuuccaggcagucuggggguguauccaggagucuuggcccugccacagcccaggcugccuggcccugugcagagagcaggugggcaggguu

SEQ ID NO: 2245463 - RNA, 65 nt, Homo sapiens
acagcagcaccaaacagacuaagacauauaugcauaguuguguucuuagauuuuguuguuguugu

SEQ ID NO: 2245464 - RNA, 72 nt, Homo sapiens
ugcaagauaggcaguuugcacuagauucauuugcauguauauaacauugcaguguaagcuuucuucuaagca

SEQ ID NO: 2245465 - RNA, 122 nt, Homo sapiens
gcagaaauauauccuggcaucaucacuuucaauagcuggauguauguuaagugaaucauugccaccccagagguggauuuccuucuauauauauuuuaaugaacucgagucaggauuuuugc

SEQ ID NO: 2245466 - RNA, 129 nt, Homo sapiens
agaaaaaaaaagggaauggggugggggauggaaauagcaccaggguugacugaccuuuaccgaggagggaaggcuuaguguuuucagccuggugucccccgugucccgauugcagcccccuguacuucu

SEQ ID NO: 2245467 - RNA, 55 nt, Homo sapiens
gaugcugaauggcacuuagggcacagcuuccguucaagugcauugauucaguauu

SEQ ID NO: 2245468 - RNA, 64 nt, Homo sapiens
auugugaauagugcugcaauaaacauacaugugcaugugucuuuauagcagcaugauuuguaau

SEQ ID NO: 2245469 - RNA, 63 nt, Homo sapiens
ugcaugucccguugugacuuacaauggggcaaugcuugaugugacuuacaauggggcaaugca

SEQ ID NO: 2245470 - RNA, 61 nt, Homo sapiens
ugggauucaguuaagggucuugagaugggaagaucaucuuggauuaccugggugggucuua

SEQ ID NO: 2245471 - RNA, 102 nt, Homo sapiens
cauagaacuagacuucucauggauggucuggcagccagcaguaguuuucuggcuacaaugcuagacaugucacaucuccagaugagggguauaagaauuaug

SEQ ID NO: 2245472 - RNA, 99 nt, Homo sapiens
aucaaucacuucuucaagguaugaccaugauccuugccgaccaccuucccacagugggucaagagaggucaugguuuucuuuaauaggaaguuugugau

SEQ ID NO: 2245473 - RNA, 55 nt, Homo sapiens
cuuguaaucaugguggaaagggaagcaaacauauccuucuucacauggcagcagg

SEQ ID NO: 2245474 - RNA, 67 nt, Homo sapiens
ucucuuuugcacaguaggugguaggacuuugucaugacaaggacuacagacccacuguagaaacaga

SEQ ID NO: 2245475 - RNA, 113 nt, Homo sapiens
ugaccuugaacuugagcacuguugaaaucucaugaugccuaugcaggguuguggucaucaggauuggcaagauagcauaugaggaacucagcaaagcagcugguucacuguca

SEQ ID NO: 2245476 - RNA, 82 nt, Homo sapiens
uggauuuuguaguagaucuggcaucucaguggaaucuugaaaaacugagcauuccauaggcuagaucaaccaguagauucca

SEQ ID NO: 2245477 - RNA, 66 nt, Homo sapiens
uguuguugguucuguuuauaugcuggauuacguuuauugauuugcauauguugaaccagccuugca

SEQ ID NO: 2245478 - RNA, 61 nt, Homo sapiens
gggaaguccacugucugguaaggggcugauucuuggcuuauuaacagacaagugucuuccc

SEQ ID NO: 2245479 - RNA, 56 nt, Homo sapiens
gcuucacuuggcuaggaaagggaauuccccgaccccuugcacuucccaggugaggc

SEQ ID NO: 2245480 - RNA, 61 nt, Homo sapiens
guuuuuaguccucugaaaaucuauaauauucuauaauugagagaucggagggauuaaaaau

SEQ ID NO: 2245481 - RNA, 123 nt, Homo sapiens
cggcauggcuagcccugggaggcuccugggcuccugugggacaacccagacuguguccaguggguaacacugucaugucucacaggcauccagagaacccuugggcugagguaggugaugcug

SEQ ID NO: 2245482 - RNA, 73 nt, Homo sapiens
uuccugucaauauuuacuguuucuuuguugauuuacugaaugugaauugcauaugcaguagaucuaccaggga

SEQ ID NO: 2245483 - RNA, 76 nt, Homo sapiens
aauuuagauuauuccuuugaauggccaaaaagaccuagcgugaggaauuguggucagucaaaagaaaguuuagauu

SEQ ID NO: 2245484 - RNA, 78 nt, Homo sapiens
ugcugacucugcaauggagaaagugagacugguuugucuccagcucugcuuacacuuuucauucguagagggaaagca

SEQ ID NO: 2245485 - RNA, 70 nt, Homo sapiens
aagcaguaaaggcacacacuccuuguuauauuccugggagaugaaaggaauacugugccuccugacucuu

SEQ ID NO: 2245486 - RNA, 81 nt, Homo sapiens
uuugauuccacagccgauaccaugacuacuaagcuauacugucucccucuguggaucacugggcgugcugugugaaacaaa

SEQ ID NO: 2245487 - RNA, 60 nt, Homo sapiens
gucucugagaugucaacaccuauucuugccuucugauaggaguugcaugauuuuuagagc

SEQ ID NO: 2245488 - RNA, 62 nt, Homo sapiens
guggaaggcaagagaaaauuucgaguuauacuagauaaaucaaaaagcuuuugcucuuucac

SEQ ID NO: 2245489 - RNA, 82 nt, Homo sapiens
gacugcuccaaugcacuccagccugggcgacagagcaagacuccgucugggucggggcggggugugggggaagccaguaguu

SEQ ID NO: 2245490 - RNA, 77 nt, Homo sapiens
uaaaacugagcuugcuuuguguaagcuacuauaguauuucauacauaucagaguuacacugaagacuaguuguuuua

SEQ ID NO: 2245491 - RNA, 68 nt, Homo sapiens
ggguacauaugcacaacgugcagguuuguuacauauguauacacgugccauguuggugugcugcaccc

SEQ ID NO: 2245492 - RNA, 63 nt, Homo sapiens
ucucuauacuacguuuuccacacagcgcucggcacugagccaugggguaaaugugauaagagg

SEQ ID NO: 2245493 - RNA, 60 nt, Homo sapiens
gggagauacaaugauugguucucacccagguggaucugaguggagacucauugauuuccu

SEQ ID NO: 2245494 - RNA, 67 nt, Homo sapiens
uugaauucuugcauuuuuaaauagugcucaauauuugagugaacuacuguaagcugcaagauuuuaa

SEQ ID NO: 2245495 - RNA, 83 nt, Homo sapiens
cuugaccaggcauuaggaccaggcuuggagauaggggucagugaugggcucuuguacuacuuaggaucuggagucuggucagg

SEQ ID NO: 2245496 - RNA, 59 nt, Homo sapiens
ucucagcacaaacaaaauugcuuguaaaggagcaaggcaauugcacaaugugcuguagg

SEQ ID NO: 2245497 - RNA, 82 nt, Homo sapiens
gagauuuuuuaauuuaguauguacaguugucacauugucagagacuucauugagauaaagcauguacuguguuaagaauuuc

SEQ ID NO: 2245498 - RNA, 66 nt, Homo sapiens
ucaguuaaugaguugagauaagguuacauuuuguagacauuugaugaaccuauuuuaacuuccuga

SEQ ID NO: 2245499 - RNA, 56 nt, Homo sapiens
ugaaugcaucauguagggcucacaguagaucuuacagcccagacaugaagcauuca

SEQ ID NO: 2245500 - RNA, 61 nt, Homo sapiens
agcacggugggaugagcaucuauaaagauauacauauguagaucaucaaguuuacugugcu

SEQ ID NO: 2245501 - RNA, 94 nt, Homo sapiens
cauguucaguauugaaauccauucuuggcuuugcuuuaauagcagagauuugacuucugacauuguugaucacagccauggaaauaaccacgug

SEQ ID NO: 2245502 - RNA, 84 nt, Homo sapiens
ggguuccaagucuuugcuauuguggauagugcugcaguaaauacacguaugcauaugucuuuauaguggcaugauuuauaaucc

SEQ ID NO: 2245503 - RNA, 65 nt, Homo sapiens
gcuuugaggaguguauuucauucgcucuauuagcuuuagagccaaggacaugcacuucuuagagc

SEQ ID NO: 2245504 - RNA, 71 nt, Homo sapiens
agauagagagcuagcugggugaucacugggaauuuagcaacuuuuccaugagaauaguuaggcucuuaucu

SEQ ID NO: 2245505 - RNA, 99 nt, Homo sapiens
gaggcaggagaauggcgugaacccgggaggcggagcuugcagugagccaagaucgcgccacugcacuccagccucggggacacagcgagacuccaccuc

SEQ ID NO: 2245506 - RNA, 113 nt, Homo sapiens
uuuagauggacuacagugaaaagaaaucacuagguaguaaucugcagagaaagccauucucuuuuauccuaucuuugcauuuccucuuaguuucugcacuaguuauaucuaga

SEQ ID NO: 2245507 - RNA, 64 nt, Homo sapiens
uucuuuggucaucaugggaagcaaggacuuccucagccccugccccucuccugugauccaagaa

SEQ ID NO: 2245508 - RNA, 82 nt, Homo sapiens
gaagggcauagugacuagggaaaauuauuuuguuuucuucagugauugagaaucuucuaauuuccuuaguacauuuuccuuu

SEQ ID NO: 2245509 - RNA, 79 nt, Homo sapiens
cuguuugguuaucuuuuccuguccauuguuauagucagauacaagaggguaaugaaaaauagaagagaaaagugaacag

SEQ ID NO: 2245510 - RNA, 60 nt, Homo sapiens
uagcaauuccuuucccucagacaaauaucugcuggugugcagugaggaaaggguuugcua

SEQ ID NO: 2245511 - RNA, 56 nt, Homo sapiens
gucuggaccaagugcucacucacccuucuucuugguuuggcacuugacguccggau

SEQ ID NO: 2245512 - RNA, 56 nt, Homo sapiens
aggauuauuauugugaugugguuuacacucgucauuucacagucacacauaauccu

SEQ ID NO: 2245513 - RNA, 103 nt, Homo sapiens
caauguuggagguggggccugguggauggugauuggaucauggaggugaauuucucaugaauuguuuagcaccauucuccuugguacuguccucaugauagug

SEQ ID NO: 2245514 - RNA, 60 nt, Homo sapiens
ggaguaaaugugugcauuucaaacuuuauguacuacuuuguaacacacacuguuuacucc

SEQ ID NO: 2245515 - RNA, 96 nt, Homo sapiens
ugugacuuuggcuucucauuacaagguaaaaguaaagcuuuuauucagagaacagugagagcuuuuuugccuggugaucaaaaagucaguauuaua

SEQ ID NO: 2245516 - RNA, 78 nt, Homo sapiens
aaaguuuggauuagauaauugagaucacuguuccuaauauagcucuuguugagaucaguuguuauaauucuugauuuu

SEQ ID NO: 2245517 - RNA, 107 nt, Homo sapiens
uauaccacauugagaauguuuagguuggugcaaaauuaauugcggguuuuugccauuacuuugcaccaaccuaauauuuaagaaaacgcauucuauuugaugguaua

SEQ ID NO: 2245518 - RNA, 122 nt, Homo sapiens
ccuggcuaacuuuuuaaauuguuuguagagauggggucuugcuaugauucccaggcuggucuugaauuccugggcucaaguaauacucccaucuuggccucccaaagugcugaguuuacagg

SEQ ID NO: 2245519 - RNA, 81 nt, Homo sapiens
uucuacuuuuugugaagcaaauuaaucagggagacuuuugauguuuuguugauauggcugcuuaccauaauacagugugaa

SEQ ID NO: 2245520 - RNA, 98 nt, Homo sapiens
uauagccaguuuuguguaugguaggaugacggagucuaauuuuauguuuuucuguauagauacccauucucucauuccuucaugccauccugacuaua

SEQ ID NO: 2245521 - RNA, 55 nt, Homo sapiens
guauugccugugugccagccacucgcccagaguggcccgggcucagaggcagugc

SEQ ID NO: 2245522 - RNA, 94 nt, Homo sapiens
aguacacauaguguuuagaacagugcauggcacacaguaauugcuuagugaauguuuacugucaucauuucuaugugccaggcacuaugguacu

SEQ ID NO: 2245523 - RNA, 58 nt, Homo sapiens
auucaagaggaacaggcucucaucagacacagaaucugcuggugccuuguucuuggau

SEQ ID NO: 2245524 - RNA, 59 nt, Homo sapiens
auuucuuuucgugacuuauugcaguggcuaagaccugcaguacaauguggaaaaggagu

SEQ ID NO: 2245525 - RNA, 63 nt, Homo sapiens
cugucuuugggacuggaaggaguaaggguuuccuuccuuauagcacuagauuuuaaacgacag

SEQ ID NO: 2245526 - RNA, 73 nt, Homo sapiens
guuggugacauguggcccagaugagugugcuaauggaaucauuuguacccuuucuaugaggccaagcacuagc

SEQ ID NO: 2245527 - RNA, 58 nt, Homo sapiens
acccgggagauggagguugcagugagcugagaucgcaccauuacacuccaaccugggu

SEQ ID NO: 2245528 - RNA, 84 nt, Homo sapiens
ugggacucccagggauucugaagugucacgcuaguccauggguacauuuauggcuuuguuaacauuuucuuuccugcuuaccca

SEQ ID NO: 2245529 - RNA, 70 nt, Homo sapiens
ccucacuucccuauuagcucacgucaucuuugugcaagaaggaucacaugucagccguggggaagaaagg

SEQ ID NO: 2245530 - RNA, 101 nt, Homo sapiens
cuucacaaaaaucuucaugagcugguacuaauauuaucauucucagcuuccuggugggguuugguaacgugucuaguuugcacagcuaggaagugguggag

SEQ ID NO: 2245531 - RNA, 113 nt, Homo sapiens
agagaacuuuuuaaaacuuccuuuucuaggugcaugcuucacuggauauugauaaucuuucuuuucucuguguucucuagagcuguacaaagaaaggugauucuaaaaucuuu

SEQ ID NO: 2245532 - RNA, 59 nt, Homo sapiens
agugcaauauguuuguuuacaucaacaucaccauaaacaugugagcaaugcauugcacu

SEQ ID NO: 2245533 - RNA, 83 nt, Homo sapiens
uggagaaauaagcauagcagcauauguaauguugaaacuggucuacuuacuugaauauucaucugcucuaaauuuagacucua

SEQ ID NO: 2245534 - RNA, 99 nt, Homo sapiens
gaugguucuaacacauagaaaugguaaguacucaaggugaugaaugcccuaaaugccaugacuugaucauuacacauucuauguauguaacaaaauauc

SEQ ID NO: 2245535 - RNA, 76 nt, Homo sapiens
cucucauaagcaauuuccauucagguucaagucaucaucgagaggagaugaugccuagagucaguggaggugagag

SEQ ID NO: 2245536 - RNA, 57 nt, Homo sapiens
uucaagucaaggaaagaggucugagaagaacaacucugccaucaccuugaucuugga

SEQ ID NO: 2245537 - RNA, 65 nt, Homo sapiens
uugauuuccucaccgguaaaauggcuguuauaauccuauagucaugcaaugcaaggggaaauuga

SEQ ID NO: 2245538 - RNA, 56 nt, Homo sapiens
agcagcauuccaaaaaucugcuugcaaugaggagguaacucagauuggaagcugcu

SEQ ID NO: 2245539 - RNA, 59 nt, Homo sapiens
uguccuggcaggggugugcuucaggggcagagcccucauggagaaccucugcuaggaca

SEQ ID NO: 2245540 - RNA, 119 nt, Homo sapiens
gcucugcaauaaagaagugacugaaaacuauagcacugguuuuucuugguuggaugaauuaaugcacauucugaaaaacaguguuuuagauuucaaguuccaggucuuccagaaggagc

SEQ ID NO: 2245541 - RNA, 63 nt, Homo sapiens
gugaugguccagggaaucucuuuugggcacuucuugcucuaagaccugaaagacuuuugucac

SEQ ID NO: 2245542 - RNA, 70 nt, Homo sapiens
acuuggcuccuauaggaaacauacgugacuaggccaggggcuggcaaauguuuucuguaaagggccaggu

SEQ ID NO: 2245543 - RNA, 79 nt, Homo sapiens
ggaucaccugggagcuuuuauaaguauaaacucucaguugaaucaggguuugcaucuuagaaaguucuccaggugauuc

SEQ ID NO: 2245544 - RNA, 81 nt, Homo sapiens
gagacagggucuugcucuguugcccagauuggagugcaguggcacaaucacaauucacuacaggcuugacuucccuggcuc

SEQ ID NO: 2245545 - RNA, 56 nt, Homo sapiens
agaguggauagcugugguguuggagcuugguucucucucacugagcccuucacucu

SEQ ID NO: 2245546 - RNA, 129 nt, Homo sapiens
gauacccaguuaaaugggaauuucagauaauagacaaugguuuuuuaguauaaguacaucccaaguauuguacaagauguacuaaaaauuauucuguguuuaugugaaauucaaauuuaacuggguguc

SEQ ID NO: 2245547 - RNA, 55 nt, Homo sapiens
accuuuuacggugugacuagcaaaugccgugguuuuugcaaagucagugaagggu

SEQ ID NO: 2245548 - RNA, 112 nt, Homo sapiens
gcuacccaggcuggaaugcagugaugugaucauagcucauuguaacuucaaacuuucaaacuccugggcucacaugaucacaugauccuccugccugagccuccugaguagc

SEQ ID NO: 2245549 - RNA, 96 nt, Homo sapiens
agcuuugaaagucuucccugggcucuagaaacaccaccagguggucuaugcgggguacccuugaguguguuucaggcagggugauggguugagguu

SEQ ID NO: 2245550 - RNA, 57 nt, Homo sapiens
aauuccuaagagucuauaugguacauuucaucagugaucugugagaccuuggggguu

SEQ ID NO: 2245551 - RNA, 129 nt, Homo sapiens
aagugcugggauuacaggcgugagccaccacgcccggccuacagucuuuuuucuauacacuuaagaaaacaaaguuagaagacuauucuggguugggcgcgguggcucacgccuguaaucccagaacuu

SEQ ID NO: 2245552 - RNA, 98 nt, Homo sapiens
gcuuacuauggugagacuacuguagaagcuagggugccccagccaacccuggaggucuacagugcaggcaguuccaccaaugaagaaugguggugagu

SEQ ID NO: 2245553 - RNA, 130 nt, Homo sapiens
uacuauccaggacucuccuggauagauacuauccaggacucuccuggauagauacuauccaggacucuccuggauagauacuauccaggacucuccuggauagauacuauccaggacucuccuggauaga

SEQ ID NO: 2245554 - RNA, 89 nt, Homo sapiens
ccucugcugagaugauguucaggcucaugguggcuucaggauuaucauaagcacccuuugucuggacauguccugaaacucagcagagg

SEQ ID NO: 2245555 - RNA, 82 nt, Homo sapiens
ugucugaguuuuuauacaggugcucuacagacaggacacucauucaagggggucuugaaaugcgauaggcauuuuucaggca

SEQ ID NO: 2245556 - RNA, 93 nt, Homo sapiens
aagacagcuguuuuucuccuguagccccaucaucuuuuguucacuaucuggucucuaaaagaaaggugggcaacaggugaccagcaguugcuu

SEQ ID NO: 2245557 - RNA, 61 nt, Homo sapiens
ggagcugguaagaucugugagccaggcucuuggugggaccucagcucacucugccgucucu

SEQ ID NO: 2245558 - RNA, 80 nt, Homo sapiens
auucuuuaaaugcucuguggguaguaaugaaacacguuuagcaaaccuaggccauugcugauuauagaacauaugagaau

SEQ ID NO: 2245559 - RNA, 66 nt, Homo sapiens
ugucuuugguucuguuuauaugcuggauuacguuuauugauuugcauauguugaaccagccuugca

SEQ ID NO: 2245560 - RNA, 68 nt, Homo sapiens
uguguugagaacuaaugauguacuaggcacuauuuugugugcuuuagauagauuuagucuuuacaaca

SEQ ID NO: 2245561 - RNA, 57 nt, Homo sapiens
guaaucucagcugagcugagauuauuugagccaccaaucuacaugagcugagauuau

SEQ ID NO: 2245562 - RNA, 77 nt, Homo sapiens
gucuucucugugugcuuaggauuugcuuauucuauaagacuguuggugaguagaacaucaagucauacaggcaaggc

SEQ ID NO: 2245563 - RNA, 57 nt, Homo sapiens
ggcaugaucuuggcucacugcaaccuccgcuucccagguucaagcaauugucaugcc

SEQ ID NO: 2245564 - RNA, 114 nt, Homo sapiens
uuccuuucuuccugccaaacaaauccagugauugugaaaaaccucucguggaagguucaagcauguuucaauaaaugaaggauuuuaauucagugaauuugcagaaacaaggaa

SEQ ID NO: 2245565 - RNA, 71 nt, Homo sapiens
augaaaagugcuuuguacagggguugaacaauguaauggaaguuggucaucucaauuaaaagcaauuucau

SEQ ID NO: 2245566 - RNA, 84 nt, Homo sapiens
gauguuuuauaaaucucugagguuaaauuuuauaguuucuaacagcugaaagcuuagaauuuuggcuucaucauuguagacauc

SEQ ID NO: 2245567 - RNA, 108 nt, Homo sapiens
gacaaccaaaaauguucuaaugauaaguuugucuuuguaaagauauucacucauagcccauucuauggucuuuggaaagacaaaguucaugucagauguugauuuguc

SEQ ID NO: 2245568 - RNA, 67 nt, Homo sapiens
uuugaaaaaaugucaucuucaguuguacaguuuucuagauuuuuacaagagggugacauacuuuaaa

SEQ ID NO: 2245569 - RNA, 82 nt, Homo sapiens
ccaugcuuguuaauacucaguccuggugaggcugagauacaaggagucucacuuucauggguagcugguaugcaagcacugg

SEQ ID NO: 2245570 - RNA, 80 nt, Homo sapiens
aaagcuugcugugguagaaaguaccaaacuagaaacaaaaauauuuauuuucuaguuucuauuucagcauuuacagcuuu

SEQ ID NO: 2245571 - RNA, 59 nt, Homo sapiens
auuuuaggguuggaucuuuauuaauaugcaauaucuaugagguaucugagcccagaaau

SEQ ID NO: 2245572 - RNA, 60 nt, Homo sapiens
acagguugauuguuucuuuugcuguguuaaagacuuuguaguuugaugcaauccacuugu

SEQ ID NO: 2245573 - RNA, 71 nt, Homo sapiens
ccuucucugcuucaggguacuuguggccaaaguuagauguuuaacuaaccacuuuacaccuggugagaagg

SEQ ID NO: 2245574 - RNA, 60 nt, Homo sapiens
cuggaaacaggagacugggguuggugugaaaagcauuuagaccccuagaucuuuuuccag

SEQ ID NO: 2245575 - RNA, 98 nt, Homo sapiens
ugugcacuuucucuucuugucucuuuuaugggcuauuugcauuagcauuuaaauuaaaaaguuacaggggcucauaagaacaugaaauucaaggcaca

SEQ ID NO: 2245576 - RNA, 84 nt, Homo sapiens
guguauucagcauuuuaugugacuuauuuaauuuuuccauugaccauaugaaaggauuagagauguuauuaagaggcaauacau

SEQ ID NO: 2245577 - RNA, 56 nt, Homo sapiens
agaacucagguuauagucuacaggauggaccuugagaucugauaggccuggguucu

SEQ ID NO: 2245578 - RNA, 63 nt, Homo sapiens
uuuuucuacaucugagaauucauacuggugagaaaccuuaugaauguaaagaaugugggaaag

SEQ ID NO: 2245579 - RNA, 83 nt, Homo sapiens
gagaauccaugguuagauguauccuuuccaucugggggccugagaaaccagcugggagauacauuucuagcucuucuuuuuuc

SEQ ID NO: 2245580 - RNA, 58 nt, Homo sapiens
ggaguguuuucuaauuuucuuuguagaggacuuucacguccuugguuagguauauucc

SEQ ID NO: 2245581 - RNA, 69 nt, Homo sapiens
gaaguauguuuaagacuucaagguagacagaaaacacuaaagacuguaugccuguuucaaacaaacuuu

SEQ ID NO: 2245582 - RNA, 55 nt, Homo sapiens
caugugugcugcaacaauugaaaugaucagauuuucaauuuuugcaguccacaug

SEQ ID NO: 2245583 - RNA, 130 nt, Homo sapiens
aacccaugugaucuucaaaggguagacuguagaucuauacuguagaucuauacuguaggucuauccagucuacccuuugaagaucacacuguagaucuauccagucuacccuuugaagaucacacugguu

SEQ ID NO: 2245584 - RNA, 68 nt, Homo sapiens
aggcuggagggguggagugcaguggugugauguuggcuuggcucacagcgacuuccgccuaccggcuu

SEQ ID NO: 2245585 - RNA, 64 nt, Homo sapiens
gauggaguguuccauuugucacauuacuuuggagcuucaaaaugugccugaugggaauucuauu

SEQ ID NO: 2245586 - RNA, 60 nt, Homo sapiens
gagaaugaugguuucuagcuucauccaugucccuacaaaggacauaaacucaucauuuuu

SEQ ID NO: 2245587 - RNA, 69 nt, Homo sapiens
guguucccacucaaauucauaugcugaaggccuaaccccccaguguaaugauauuuggagagggggugu

SEQ ID NO: 2245588 - RNA, 63 nt, Homo sapiens
ggguacgagaaauagagaugaagaaggacugauuaccuccuuucaucacagucuccgaugccc

SEQ ID NO: 2245589 - RNA, 70 nt, Homo sapiens
gacaauuuucccaacaagauuuaucgaagagacuaucuuuuuuccauugugucaucuuggugggcuuguc

SEQ ID NO: 2245590 - RNA, 104 nt, Homo sapiens
aagauuucuccccuccuugaugugccagaaacaucaucucuccauuaaaauuuacaaaacggagagaugauguuucuggcacaugaagggcggagagaagucuu

SEQ ID NO: 2245591 - RNA, 64 nt, Homo sapiens
guaaucucagcuacuugggaggcugaggcaggagaaucgccugaacccaggaggcggagguugc

SEQ ID NO: 2245592 - RNA, 79 nt, Homo sapiens
cagggcauuucugucacuugaacagugugaguugggguagagaauucacagaugaggcgagaggcagagguggauccug

SEQ ID NO: 2245593 - RNA, 74 nt, Homo sapiens
gagguucugguuagacaugaauuugcgggggacauuacucaauccacuuagcaaugucguguacucaccuccuc

SEQ ID NO: 2245594 - RNA, 66 nt, Homo sapiens
ugcacaacuccaaggagugucauucauauugaugucaauuugaauggcucuuccuggaguugugua

SEQ ID NO: 2245595 - RNA, 76 nt, Homo sapiens
uuuucacuuuguuuuuggauaaguuccuuuaaaaggugucagccuuacccagcugucgcaaaaaggaagauggaaa

SEQ ID NO: 2245596 - RNA, 125 nt, Homo sapiens
caggguuugcaagagcuaugguuugcguauuucuccccucucaaaugcauguugaaauguaauugcuauugcaacaguguugagaggugagacguuuaagaggccaucaguccaugagggcucug

SEQ ID NO: 2245597 - RNA, 125 nt, Homo sapiens
cuucggccucccaaaaugcugggauuacaggagugaguuacugcacccaucaucuguucuuuuaaaaauccauggccgggugcgguggcucacaccuguaaucccagcacuuugggaggccgagg

SEQ ID NO: 2245598 - RNA, 92 nt, Homo sapiens
uguuuagaauuuccauccuaagugguguucauucuuuugaguuaaacaacugauugucaauguacccuugaacauccugggaguucaaagca

SEQ ID NO: 2245599 - RNA, 59 nt, Homo sapiens
ccauggaauacucugcagccauaaaacagaaugaaaucauuuucuuugcagguccaugg

SEQ ID NO: 2245600 - RNA, 81 nt, Homo sapiens
uuacaugauuaucucagugaauguggaaaaagcauuggaaaaacuucagcauccacucaguucacugagauaaucauguaa

SEQ ID NO: 2245601 - RNA, 67 nt, Homo sapiens
uugaggaggcagucuguccauucucagagcucaaacacagugcugggagaaccacugcucucuucag

SEQ ID NO: 2245602 - RNA, 91 nt, Homo sapiens
gggaguccuggugcaaguaauuggcgaggaguuuagacaauugugcaaccuggaugucuuugccaugcaugugucaggguugaacacuucc

SEQ ID NO: 2245603 - RNA, 95 nt, Homo sapiens
ugaccuuccuucuggucugacugaguaagcagaagcaauucauagacuuccuuccaauugcuucugcuuacucacucagaccagaaggaagguca

SEQ ID NO: 2245604 - RNA, 113 nt, Homo sapiens
uuugcacauugauuuuuuuauccugagacuuuauugaauuugcuuauuagcuuaggaagcuuuugagcugagacaauaaguuuuucuagauacaggaaaaugccaccugcaaa

SEQ ID NO: 2245605 - RNA, 61 nt, Homo sapiens
gaguuacaggaaugucagguugcugucugucuacauaugcgcacucuggauuucuggacuc

SEQ ID NO: 2245606 - RNA, 59 nt, Homo sapiens
aaagugcugagaguucuaacuucauuggcuacguaguggcaaaagcucuacagcauuuu

SEQ ID NO: 2245607 - RNA, 68 nt, Homo sapiens
uguauuuuuguaagaaucuagcucuuuauuuaauugaauaaaaugcaaacguucugacaggaacugca

SEQ ID NO: 2245608 - RNA, 58 nt, Homo sapiens
guaccugagaaguuccaggggagcaggcuggagaggcaccccuggggguuucugguac

SEQ ID NO: 2245609 - RNA, 79 nt, Homo sapiens
aggcuggagugcaguagagugaucuuggcucacugaaaccuuugccucccguguucaaaugauucuccugccucagccu

SEQ ID NO: 2245610 - RNA, 73 nt, Homo sapiens
cagcuccuagaaguuuugugcucucuugcuaacucauacuuggucuuuagcagucuguuaaaacuuuuagcug

SEQ ID NO: 2245611 - RNA, 55 nt, Homo sapiens
agagggcuugauagcucuaagcagguaauccccauuaguggaaaucagguccucu

SEQ ID NO: 2245612 - RNA, 56 nt, Homo sapiens
uguacuggaaugcauagcucacugguuucaagucagaaggcugguguuuuaguaua

SEQ ID NO: 2245613 - RNA, 96 nt, Homo sapiens
cugccuuucaacuucaucucucugacagugguuagcacuguacuuuacguguaguaagugcucaauaaaugcuuguggacuggaugauuggggcag

SEQ ID NO: 2245614 - RNA, 68 nt, Homo sapiens
gcugaacuguuucuggugaaagaguagccuuccuucgcgggcacugacacugagggaagcagcucagu

SEQ ID NO: 2245615 - RNA, 62 nt, Homo sapiens
guguuaaauggcagggagcgucccgcaagauuccucugugguugagcuuugccaugaggcac

SEQ ID NO: 2245616 - RNA, 71 nt, Homo sapiens
auauaauguacuucuuuugguuauaaugguaaaauacaaaacugauuagggcaggagcaaguacggugugu

SEQ ID NO: 2245617 - RNA, 71 nt, Homo sapiens
uucuguguaugcaaggaaguaaguugggaccuuuaguguguguuucccagacuacccuaguauauacagaa

SEQ ID NO: 2245618 - RNA, 57 nt, Homo sapiens
ccaugaaagugauaaaugucucuaaccaggguuagaaaagauguuguccuuuuaugg

SEQ ID NO: 2245619 - RNA, 66 nt, Homo sapiens
ugucucuuccuaucugugggaaaugauucaaaugauagauucaaggacucagagagggauuagaca

SEQ ID NO: 2245620 - RNA, 63 nt, Homo sapiens
uuuguaucugcagucuaucacugacagaaacacuggugugcagugcaugacuguauaugcaaa

SEQ ID NO: 2245621 - RNA, 78 nt, Homo sapiens
uucaguuuccauguaguugagcaguuuugagugaguuccuuaauccugaguucuaguuugauuacacuguggucugag

SEQ ID NO: 2245622 - RNA, 68 nt, Homo sapiens
uucuccggguggcggcgaagggaccgccgcucauccugccugcaucccuccgccgccugccuggagaa

SEQ ID NO: 2245623 - RNA, 82 nt, Homo sapiens
ccaagguugucagcugccuuuccagacauugauaggcaccuugccucuuaggguuaaaugucuguagaugugcugaaccugg

SEQ ID NO: 2245624 - RNA, 59 nt, Homo sapiens
cuggacauguccuuaaccuuggaaaaagaaacuucuaaauuaauugaggcaugucucag

SEQ ID NO: 2245625 - RNA, 62 nt, Homo sapiens
uagcacuauguuaucacauacuagguagugucuuuucuauuuuggugguauacaugcugcua

SEQ ID NO: 2245626 - RNA, 62 nt, Homo sapiens
gcuuagcaacagcaauauguucugagaaauguauugucagaugauucuguuguuguguaagc

SEQ ID NO: 2245627 - RNA, 72 nt, Homo sapiens
ggagcagacauggaucuaacugggcuggcaggagccaacgauuaucuugaggacugagacagaccaagcucc

SEQ ID NO: 2245628 - RNA, 86 nt, Homo sapiens
ugaauauuauuuggcuguauggauguacuauguuuccuuuauucuuuugcaaguaaauauccgguagucccagcaccauuuauuca

SEQ ID NO: 2245629 - RNA, 69 nt, Homo sapiens
gagauucugguauguugucucuuuguucucauugguuucaaagaacuucuugauagcugccuuaauuuc

SEQ ID NO: 2245630 - RNA, 102 nt, Homo sapiens
gcguguggcugaccuugagguuauuggggugcuuguguguccacgccaggagcauggcagcaaacagguccccagugcccacaaagacggcguccacuuugc

SEQ ID NO: 2245631 - RNA, 57 nt, Homo sapiens
gaggagaaugcugauaauuggugaaacuaggugauaggaguuuauugcauucuucuc

SEQ ID NO: 2245632 - RNA, 68 nt, Homo sapiens
gggcaagucuuuguugcauaggcuuguucuguucaucauaggacauuuagcucagcugacaccugccc

SEQ ID NO: 2245633 - RNA, 58 nt, Homo sapiens
uuugcuauagugaauagugcugcagugaacauaugcgugcaugggucuuugugguaga

SEQ ID NO: 2245634 - RNA, 56 nt, Homo sapiens
uguggcccagucaaguugacauauuaaauuaaguaucacacuuucucugugccaca

SEQ ID NO: 2245635 - RNA, 56 nt, Homo sapiens
gucagcuuuuccuuacuuuaggacaugcucauuuguucuugaguuccaaaacugac

SEQ ID NO: 2245636 - RNA, 81 nt, Homo sapiens
cuuuaagucuccaugaggaagacaggugacauacauaagguucaguggcacuuuggcuguguuccucaaggagucucagag

SEQ ID NO: 2245637 - RNA, 60 nt, Homo sapiens
gugauuucuaacuuaaaaugaggggagauuugauuguuucuucuugaguuaacaaguuac

SEQ ID NO: 2245638 - RNA, 63 nt, Homo sapiens
cuuguagaguuguuaaaaauguggaguaccagauccucccucuaugguuucuaauucugcagg

SEQ ID NO: 2245639 - RNA, 79 nt, Homo sapiens
uuugcccucuuggucuccuugauuagaguauagaguggccuggccaucucacuguauccagggguccauagucagcaaa

SEQ ID NO: 2245640 - RNA, 67 nt, Homo sapiens
auagauucauuugaggagauuugagaacaugagccaauuccugcaacaaaucucuuuauauaucugu

SEQ ID NO: 2245641 - RNA, 120 nt, Homo sapiens
gcugcuugagaagaggcagcuuguuuggcuacuuggucagcuagauuauucccucagcucuugaaggaaagauucuucuagugaccuggaacaugaacaacugcuaucucuucuggcagc

SEQ ID NO: 2245642 - RNA, 62 nt, Homo sapiens
ggagugggcgggaggccugcacguggggacagucccucagugcacaaccucacccccgcucu

SEQ ID NO: 2245643 - RNA, 68 nt, Homo sapiens
ggguacaugugcacaacguguagguuuguuacauauguauacaugcgccauguuggugugcugcaccc

SEQ ID NO: 2245644 - RNA, 62 nt, Homo sapiens
agcugggucuagggagcaggaggacagggacgagcugguccuugagccucccagacucaguu

SEQ ID NO: 2245645 - RNA, 130 nt, Homo sapiens
uugaaccaagagaaauggcuuucccuaggaguuuguuagaaaugcagagucucaggcucccggaccugcugccugggaagcugcauuuuaacaagauacucgggugauuugugcacaccuuagaguucaa

SEQ ID NO: 2245646 - RNA, 56 nt, Homo sapiens
auaagagcaggcuucuggccagagugagugcagcucugccuugaagcaacucuugu

SEQ ID NO: 2245647 - RNA, 58 nt, Homo sapiens
uucucgcuuuuuccaccuguaucgugcuugcgccccauccaggugugaagagccggag

SEQ ID NO: 2245648 - RNA, 62 nt, Homo sapiens
auggugcugggaaaacuggcuagucauaugcagaaugaaacuggaccccuacuucucaccau

SEQ ID NO: 2245649 - RNA, 59 nt, Homo sapiens
cagacuugggaauguccuaauaucucgauaucuugagaacaaaggcauuccuaauuuug

SEQ ID NO: 2245650 - RNA, 126 nt, Homo sapiens
auguaaagcacgaguaaauagaaaugguuuacaggcuguaaaguaagagguaaguuaaguauucaauuuuaaguuggcuucguuacuuuaaaugugaacucccuucaccuuuccuaugcuugauau

SEQ ID NO: 2245651 - RNA, 64 nt, Homo sapiens
auugugaguggugccgcaauaaacauacgugugcaugugucuuuauagcagcaugauuuauagu

SEQ ID NO: 2245652 - RNA, 56 nt, Homo sapiens
gaggugggcggaucaugaggucaggagacagagaccaccgggugaaacccuaucuc

SEQ ID NO: 2245653 - RNA, 113 nt, Homo sapiens
aaauauauauauaauuuuuaguuuaucaaauccucaccucaucaugaaauuuuacuucauuguuaauauucaugcuugguguggggauuaugaauuaauguaaguaaguauuu

SEQ ID NO: 2245654 - RNA, 69 nt, Homo sapiens
agggugucaucacaguuaagaggugaugaaaauccuguuucuucacuauucuuccuuugaauacacccu

SEQ ID NO: 2245655 - RNA, 106 nt, Homo sapiens
uuagauuugacugccuuuuaguuuacaggugaaugcucacauucuaaucagagaagaugauugggauauaaagcauucucagaaaccaggaaguaugcauuucuga

SEQ ID NO: 2245656 - RNA, 66 nt, Homo sapiens
ucucuuucccaguucacagaaaugcucugagcaccaugcuaccauugcaguggaguggggaagagg

SEQ ID NO: 2245657 - RNA, 126 nt, Homo sapiens
gggcuggagcagaugauuuuagaagucucuuucaguucugauagucucugauuuuguggaauaguagaucucaacacuggaaguacaucagagucguguggaacuugugaaaaacuguuccagucu

SEQ ID NO: 2245658 - RNA, 55 nt, Homo sapiens
aacaguguaaauccagguucgaguacuaaagcuuauaaccgggagugcacauguu

SEQ ID NO: 2245659 - RNA, 82 nt, Homo sapiens
auauauauauauguacacauacauauauguguguguauauauauauauacacacguaugugugugugugugugugugugugu

SEQ ID NO: 2245660 - RNA, 71 nt, Homo sapiens
ucaaaaauauucccaggaagucuaacuagcugugucauccuuauucuaagacuuuuugggaauauagauga

SEQ ID NO: 2245661 - RNA, 71 nt, Homo sapiens
ugauccuacagaaccaugcuuuucuuaccaguguuuaauauagagucaaauaagcauggguuuuaggguca

SEQ ID NO: 2245662 - RNA, 72 nt, Homo sapiens
uuuauuucugccagucuaugcuaaugugaaugaauucccuaucuguauuagugucuuuugguuagaaguaaa

SEQ ID NO: 2245663 - RNA, 75 nt, Homo sapiens
cuaagcauuaaggguuuuagaauuuuccagcucuuucuagcacuggaauuucucaaaauuccuuauuuggcuugg

SEQ ID NO: 2245664 - RNA, 81 nt, Homo sapiens
cuggaucugugucuugccuacagaaggggcucagcaaggugaaccugcuuccuugucccucugagguuuuuccauguuuag

SEQ ID NO: 2245665 - RNA, 88 nt, Homo sapiens
ggagaauugcuugaagccgggaggcggagguugcagugagccgagauugugcuacugcacuccagccucggugacagagcgagacucc

SEQ ID NO: 2245666 - RNA, 84 nt, Homo sapiens
agugccugauacacgguaggcacauauuuauuuguucagccauuuaacaaacauuuagggagcaccugcugugugccaggcacu

SEQ ID NO: 2245667 - RNA, 77 nt, Homo sapiens
gggcaaaagggcacuguagguccugccucccucucaccccaaguuacagggauaggcagcccugccaggcccagccu

SEQ ID NO: 2245668 - RNA, 56 nt, Homo sapiens
aagcacgauggggucacgaugagacggguaacauucuuucacguguccaucugcuu

SEQ ID NO: 2245669 - RNA, 73 nt, Homo sapiens
gggccucuucaguguuuuuccuuuaaugaggguuugauccccucaaugacagcaucaggauuggagaggaccc

SEQ ID NO: 2245670 - RNA, 70 nt, Homo sapiens
aguguuuugugauauguggauucagcucaaagaauuaaaccuuucuuugauucaguauguuggaaacacu

SEQ ID NO: 2245671 - RNA, 58 nt, Homo sapiens
aagugcagggacuaagacaugagccacugugcccggccuaugccucaguuuuguacuu

SEQ ID NO: 2245672 - RNA, 76 nt, Homo sapiens
cagaguuuaagcauagguuauucauucaucauuuacuccuucaauaaauguuuacugaaugcuuagcaugacucug

SEQ ID NO: 2245673 - RNA, 79 nt, Homo sapiens
caugccacaugggaacucggugaauaaauaccccagcucccucaccccugggguaggcuacacugaguuccccaguaug

SEQ ID NO: 2245674 - RNA, 129 nt, Homo sapiens
agaaaauaacuuucuguuguuuaaaccacucagucuuagguauuuuguuaugucagcuugucuuagucaguuggggugcuauaaaaaugaucuuacacuggguggcuuaaacaauacaaauguauuucu

SEQ ID NO: 2245675 - RNA, 77 nt, Homo sapiens
ccucugucaaauugggguccgaaccagauggguuccaggcccgcuggugaucuagacccccaagaagucugcagagg

SEQ ID NO: 2245676 - RNA, 55 nt, Homo sapiens
uuguuuagaugggugcuucaccuuggccagucaccaugagagcacaacugaacaa

SEQ ID NO: 2245677 - RNA, 64 nt, Homo sapiens
uucaguuugccaguauuuuacugaggauuuuugcauugauguucaucagggauauuggccugaa

SEQ ID NO: 2245678 - RNA, 64 nt, Homo sapiens
uucaguuugccaguauuuuauugaggauuuuugcaucgauguucaucagggauauuggccugaa

SEQ ID NO: 2245679 - RNA, 66 nt, Homo sapiens
uagaauacuauccaauugccacaagaaaugaacuagauguauauauggcaacauggauggauucug

SEQ ID NO: 2245680 - RNA, 95 nt, Homo sapiens
guguguacauuugggggauugggagagaaggauggauaaggggagaggcagagagauugucacccuuuauccauuuccucuuuugugugcuccac

SEQ ID NO: 2245681 - RNA, 58 nt, Homo sapiens
cauggcuuuaagcaacaccaaggcaaguacaugggucugggugaugcauaaacccaug

SEQ ID NO: 2245682 - RNA, 129 nt, Homo sapiens
acuccuggacucaagcaguccucccgccucagccuccuaaagugcugagaugaggcugggcgcgguggcucacacuuguaaucccagcacuucgggaggccgaggcggguggauaacgaggucaggagu

SEQ ID NO: 2245683 - RNA, 58 nt, Homo sapiens
ugagacugagucucccucugucgcccaagcuggagugcagaggcguaaucucggcuca

SEQ ID NO: 2245684 - RNA, 69 nt, Homo sapiens
ucgugcacagucaacacuuauucaccaucaggcaauccaugguguagggaaacuugacuaauguaauga

SEQ ID NO: 2245685 - RNA, 66 nt, Homo sapiens
gcccaaccuccaaauaccauuauauugaagguuagcauuucaguauaugaaucuggggcagggggc

SEQ ID NO: 2245686 - RNA, 82 nt, Homo sapiens
ugcaacugaggagaaaggagcagugcuuuuggacggcacaagggcuguuucauggacgcaaugccuuuucaaucucagugca

SEQ ID NO: 2245687 - RNA, 83 nt, Homo sapiens
agaaucgcuugcacccggagguggagguuguagugagcugagaucaugcuauugcacuccagcuugggugaccgagugagacu

SEQ ID NO: 2245688 - RNA, 63 nt, Homo sapiens
guucugugagucuugacgaauguguacagucauguaacuagcaccacaaucaagauacagaac

SEQ ID NO: 2245689 - RNA, 97 nt, Homo sapiens
guagaauuuuacuguggaauuucaguguuuuccuuuaacucuuugugcuagaauaaacaggagcuuuggggaaaacagaucuauuuugaaguucugc

SEQ ID NO: 2245690 - RNA, 77 nt, Homo sapiens
cuccugggaugacaugaagaaaaacagauuucuuucaaacagagaagucuuuggugccuuuucugucuccccagugg

SEQ ID NO: 2245691 - RNA, 56 nt, Homo sapiens
uuuagcagcaaagagcuguguucugucaaagacagagcagcucucagcuugcuaag

SEQ ID NO: 2245692 - RNA, 57 nt, Homo sapiens
gugggguaggcaauuccuaguggcugugaagaaguagauaggagccugcuaccccac

SEQ ID NO: 2245693 - RNA, 86 nt, Homo sapiens
uauguguguauguaaauacaugcauguuaaaauauagguguguaguagcaggcauguaaacauguauguguuuauguacauauaug

SEQ ID NO: 2245694 - RNA, 73 nt, Homo sapiens
cuggucuggagagugauaaguaaauggagaaauaaucaguuuuacucuagaacuagaucaccucaacagucag

SEQ ID NO: 2245695 - RNA, 64 nt, Homo sapiens
agugauauguuugccuugaggggagaaguaacaugcuuguccauaggagguagauauuaucacu

SEQ ID NO: 2245696 - RNA, 89 nt, Homo sapiens
uagcagugucuuuacuauucacuguggguccuuuggauaguuuaugcuaaccaggugacucauggugagccccuagauaguuuuugcua

SEQ ID NO: 2245697 - RNA, 63 nt, Homo sapiens
ugagcuguuugaagaagcauuugccauuuuccggaaauuugaugucaauacuucagcaguuca

SEQ ID NO: 2245698 - RNA, 100 nt, Homo sapiens
acaguagagugggcguacacccugugauauuauuuguaauauccuagaaagauauugcuccuaauaucacgguggcucuacacccugugaucuuaauugu

SEQ ID NO: 2245699 - RNA, 57 nt, Homo sapiens
cugguuuugucagaagcuuuauuucauugaugguuuacugcaucuacuuagagccag

SEQ ID NO: 2245700 - RNA, 109 nt, Homo sapiens
uuuguuuugcacugcuucacucuacaaccuguuggggugaaucauacuuuguuauuaauugcucugaggcacucccuagcgggguggagcauuuggaguccugaauaaa

SEQ ID NO: 2245701 - RNA, 66 nt, Homo sapiens
ugugugugugugugugugugcguguuagcagaagcugguaauagcucggauaaacaugauuucaua

SEQ ID NO: 2245702 - RNA, 129 nt, Homo sapiens
gcugccuaaaccacagccugcccccagcugcugagacagcuuugcaagacauugcugauguacuccagcugcuauguaaugaacuugaaagccuguucuguagcuggcaucaggacuggugaauuaggc

SEQ ID NO: 2245703 - RNA, 103 nt, Homo sapiens
uugagacggagucucgcucuguugccuaggcuggagugcaguggcacgaucucggcucacugcaaccucugccucccagguucaagagauucuccugccucag

SEQ ID NO: 2245704 - RNA, 60 nt, Homo sapiens
ugaagugccugugagcccugaucaaugugaaugaauguugucauggucacaggcauuuca

SEQ ID NO: 2245705 - RNA, 61 nt, Homo sapiens
gggaugcuaugugauaaaaugcacaguaaaagcauugcacugucuugucgcauagcauuuc

SEQ ID NO: 2245706 - RNA, 62 nt, Homo sapiens
gauaaaguauuggguacuaugcacaccugggugacgggaucaguuguacuccaaaccuuauc

SEQ ID NO: 2245707 - RNA, 74 nt, Homo sapiens
auuuauugacaucaaaucaacauuugaguaugguuaacuucacauaauaguguuuagauuugggauuggugaau

SEQ ID NO: 2245708 - RNA, 65 nt, Homo sapiens
gaaguuuaguguuuugaaacauauagaagcaaacacugcuucuauguuugaaaaugccaaauuuc

SEQ ID NO: 2245709 - RNA, 117 nt, Homo sapiens
acaagauucagugcacagguauaaugcauauuuugauggugaaauuaguuaauuguugguaaacacuuagaacagugcucaccacaaaguaaauggguauuaagugugcauuuuugu

SEQ ID NO: 2245710 - RNA, 70 nt, Homo sapiens
ccagaugugaugcugcucaccuguggucucagcuacgugaggcugaggguagaaggaucacuugagcugg

SEQ ID NO: 2245711 - RNA, 78 nt, Homo sapiens
aagaacugacuuuugauaguuuuaaaauuaaucuuugcaugaagguugguuucgcuuuuauccuuuaaguuuguuuuu

SEQ ID NO: 2245712 - RNA, 84 nt, Homo sapiens
ucucccaaaaagcaaagaugguggucuacccuuucccuugggaacuccauccuggggagaacugagaccucugucagcuggaga

SEQ ID NO: 2245713 - RNA, 56 nt, Homo sapiens
ugugcgaaaaccacaguagagguuuugugaagaagagcauuuguggcuuuugcaca

SEQ ID NO: 2245714 - RNA, 64 nt, Homo sapiens
guaaguaaguaagagguauuacaugcugucauagcagaauauaccucuuacuuucagcacuuac

SEQ ID NO: 2245715 - RNA, 68 nt, Homo sapiens
aagucaucuugcauucuucagaucacaguggaagaauuucaccauguguucagaaggauugcugauuu

SEQ ID NO: 2245716 - RNA, 101 nt, Homo sapiens
gaugugcugcuggauucgguuugccaguauuuuacugaggauuuuugcaucaaaguucaucagggauauuggucuaaaauucucuuuuuuuguuguguguc

SEQ ID NO: 2245717 - RNA, 90 nt, Homo sapiens
ucuuuuaucugaugagaugacuagaggagggauggccaaauaagguuuaucuggggucccaacucugauugauuggaauuggcugaagga

SEQ ID NO: 2245718 - RNA, 59 nt, Homo sapiens
uagcugguauuaggaguuguguugccaggcaugguggcacaugcuuguaauuccagcua

SEQ ID NO: 2245719 - RNA, 56 nt, Homo sapiens
uuucucuggucagaggggagguuaucuuggggcuaacaucucuguggucagagggg

SEQ ID NO: 2245720 - RNA, 84 nt, Homo sapiens
gugcagcaagccuucgauuugcucacaguuguuuuaaacauuuuuaaaaguuuaaaugcacauacuugagaaaagcugcugcac

SEQ ID NO: 2245721 - RNA, 75 nt, Homo sapiens
gcugccuuuuccccgauuuaaaccuuaucacaguccuuggagggugagauaaggaaauugaggcucagggacagc

SEQ ID NO: 2245722 - RNA, 88 nt, Homo sapiens
guuuuguccucagauacuggccuggagcugugaggaccugcuugguguuagauuuuacuacaguaggcucagugucgggguccaagac

SEQ ID NO: 2245723 - RNA, 60 nt, Homo sapiens
gucauggaaguuuaccauuccacaaauggaaaugaagcuuggaauguuaaucuccaugau

SEQ ID NO: 2245724 - RNA, 68 nt, Homo sapiens
aacugaauguaacuaaaccugugaaaauguccaaacacagcuuuacucuagguuagauugauucgguu

SEQ ID NO: 2245725 - RNA, 55 nt, Homo sapiens
gauguuggggcaagagcgggcagacauguauguuuaagcuucauguccuaacauc

SEQ ID NO: 2245726 - RNA, 79 nt, Homo sapiens
aaggagauuugcuucucuagggacuguauagaugagauuuuaacaccugugcaaugucaggagaugcagcucucuccuu

SEQ ID NO: 2245727 - RNA, 79 nt, Homo sapiens
uuagagggaaaguguucagucuuuuaccauuaaguaugacauuaguuauagguauuauguagaugcucuuccccucuga

SEQ ID NO: 2245728 - RNA, 69 nt, Homo sapiens
uaauuauuuuaaugaccuugucuguuaauucuaucaucuauaucaguucugggucaguuugaaugauua

SEQ ID NO: 2245729 - RNA, 67 nt, Homo sapiens
ucacuugaggaugugugauugcacagugauaggaaucgagugcaagucaucuguccuucagauguga

SEQ ID NO: 2245730 - RNA, 55 nt, Homo sapiens
augaguuccuuccuugccuaggugaguguaacuuauuuagcaggggguaacuuau

SEQ ID NO: 2245731 - RNA, 61 nt, Homo sapiens
gaagaggacaacuggaagcucaugccuggucucuccuggccccugcccuuugugccucuuc

SEQ ID NO: 2245732 - RNA, 56 nt, Homo sapiens
ucuugaacuucugcacacucagcgaaaauuaugcucgcguugugagagguccaaga

SEQ ID NO: 2245733 - RNA, 58 nt, Homo sapiens
uuuaauagcagggacuuccgggguagaguguuccaacccuggcuuauucucuauuaaa

SEQ ID NO: 2245734 - RNA, 74 nt, Homo sapiens
acugcaggcucaugacaaaauaaauggucucugucuuacgccgcuaaguuuagaguguuuuguuaggcagcagu

SEQ ID NO: 2245735 - RNA, 86 nt, Homo sapiens
uuagauuauuuauagaugugggcaauaagagcuacauuuauguugucagugcuguuugcccucguuuaauuucucaaaugaccuaa

SEQ ID NO: 2245736 - RNA, 68 nt, Homo sapiens
guucuucauucacucccuugaaguuaggcaugucuauuugaccuaacuccagccagugaaauuugagc

SEQ ID NO: 2245737 - RNA, 84 nt, Homo sapiens
aauuuaugagguuccuaaucuccauauguucaguuaugcagugaaauaugauuuguuugcauugcauagacauccucauagauu

SEQ ID NO: 2245738 - RNA, 83 nt, Homo sapiens
cuacaaaauuugggauuauaguagugcuggcuauuaucucauuuaauccugaggauggcccaguuugcuaucccuauuuguag

SEQ ID NO: 2245739 - RNA, 69 nt, Homo sapiens
cuacuagcaacauuucagugaguuugcaauuguuucagaauucaaaaacucauaauugaaauggagugg

SEQ ID NO: 2245740 - RNA, 67 nt, Homo sapiens
uagaugccaucacuuuuccuuuuacagauguacuguuccaucuggaaguuaagcuuggugccaccua

SEQ ID NO: 2245741 - RNA, 76 nt, Homo sapiens
uucuucucuuuugccugucuuuguucucuaccaaggagagaacuggcuuaaggaugggccacugaaaagagaagaa

SEQ ID NO: 2245742 - RNA, 73 nt, Homo sapiens
aagguaaauauugacucucgcuuugggucaauaaauucugauccauugcucaagagaagucaauaucuacuuu

SEQ ID NO: 2245743 - RNA, 68 nt, Homo sapiens
gucauuauaucauugccauggaaagggguggugacucuccgguguugccauggcaaugguaaacugac

SEQ ID NO: 2245744 - RNA, 107 nt, Homo sapiens
ugauggugagucauuuucacagaggccauugcaaaguuugccuccuguagcugauucugcagcacaggagugcugcuauuguuguuucauuuggugucuuaucauca

SEQ ID NO: 2245745 - RNA, 76 nt, Homo sapiens
uccacagguucugagcaauagauguggauaucucucgggggacauuauuuagccuauugcuacaguauccuuugga

SEQ ID NO: 2245746 - RNA, 83 nt, Homo sapiens
auguaaaugggaaacuugguuacaagccagaccaugaggacaccucauacgucuccuugugccaccccuucccacucucacau

SEQ ID NO: 2245747 - RNA, 86 nt, Homo sapiens
gguuaacugagauuuaaauacuguguaaugguuaaaggccaaugacuggggaaccucauuggcuaagcuuguuacaccucacaacc

SEQ ID NO: 2245748 - RNA, 55 nt, Homo sapiens
gcaaugcugucugugcacagaucaugaggaaggucuguggguuuugcagaguugc

SEQ ID NO: 2245749 - RNA, 55 nt, Homo sapiens
auuuguaagcuuccuuauuugugacacgaacgauauuggaggaagacuuagagau

SEQ ID NO: 2245750 - RNA, 66 nt, Homo sapiens
auaaaugucuucuuuugagaagugucuguucauauacuucacccacuuuuugaugaggucguuugu

SEQ ID NO: 2245751 - RNA, 63 nt, Homo sapiens
gagguaugagcugagaaauccuccuccuuugagacaacugcucacuuucucaguucugaucuc

SEQ ID NO: 2245752 - RNA, 58 nt, Homo sapiens
agagaugaagauggggcucccggaagccacccggccccucuggcccagucuucucuuu

SEQ ID NO: 2245753 - RNA, 61 nt, Homo sapiens
guuugccaguauuuuauugaggauuuuugcaucaauguucaucaggaauauuggccugaac

SEQ ID NO: 2245754 - RNA, 61 nt, Homo sapiens
uugucugagauggagucuuguucugucacccaggcaguggcaagaucucagcucacugcaa

SEQ ID NO: 2245755 - RNA, 130 nt, Homo sapiens
cugcuucagccucccaaagugcugggauuacagguguaagccacugugccuggcuggcacuuaguuaagaaagagggcuaggcacgguggcucacaccuguaaucccagcacuuugggaggcugaggugg

SEQ ID NO: 2245756 - RNA, 69 nt, Homo sapiens
ggaaacuggccuggcgugcagaggggagggucgcagagucaaguccccucucaccaagguuagugggcu

SEQ ID NO: 2245757 - RNA, 95 nt, Homo sapiens
ggccaggcacaguggcucauuccugucaucuuagcaauuugggaagccgagucaggcagaucaccugagguuaggaguuugagaccagcuuggcc

SEQ ID NO: 2245758 - RNA, 82 nt, Homo sapiens
ugucaaguaggcaguuagauaugagcuucuagagagaguucuagcuagagguauacauuugagagccaagaacauacagaca

SEQ ID NO: 2245759 - RNA, 64 nt, Homo sapiens
auugugaguagugcugcaauaaacauaugugugcaugugucuuuauagcagcaugauuuauaau

SEQ ID NO: 2245760 - RNA, 62 nt, Homo sapiens
uugcuuugcagccccaagaggcuucucaguaaaugccagagaugcaucuggcugcgaggcaa

SEQ ID NO: 2245761 - RNA, 89 nt, Homo sapiens
aacacgcaugaguuuguuuggauauuaggcaagaguacauucuuguguauuuaugauagaaucuuaaacagaucuuaauuaugccuguu

SEQ ID NO: 2245762 - RNA, 81 nt, Homo sapiens
ugaguuguuauuaggcuuuuguuuuggucucagguauaugacacaauaucaccuguggccagaaagaaggcaagaaacuca

SEQ ID NO: 2245763 - RNA, 75 nt, Homo sapiens
augcugcguaucaacaggguggccaguguauuuuuacauguaaguacacaaaggcacucuguuguuaccacgcau

SEQ ID NO: 2245764 - RNA, 102 nt, Homo sapiens
ugaggcaggagaauagcuugaacucggaagguggagguugcagugaggugagaucgcaccauugcacuccagccugggugacaagcgcgagacuccgucuca

SEQ ID NO: 2245765 - RNA, 79 nt, Homo sapiens
gcuuuacuuaagggaauguugugguugguuugaucuucuaucuagaccacuaaaacuuucucuauaucagcggugaggc

SEQ ID NO: 2245766 - RNA, 60 nt, Homo sapiens
uaagugaaggaaguguguuuacaaaugucauuuuugucugauuucacuuaccuucauuua

SEQ ID NO: 2245767 - RNA, 59 nt, Homo sapiens
ugacaccuggcugaggucaccaguagcugagagacuccuuagcuagugcucagcuguca

SEQ ID NO: 2245768 - RNA, 55 nt, Homo sapiens
gcaaaggucacuuuguuaagcacuagcgaagagcuuugcugcauugugaccuugc

SEQ ID NO: 2245769 - RNA, 63 nt, Homo sapiens
auuauaaaagaccaaaguggccaccuucaggagguucuuuaaggugcuaucugguuuuauagu

SEQ ID NO: 2245770 - RNA, 66 nt, Homo sapiens
ugucuccuggauauguaaaaauuauaucugaguugaacuacaguuuauuuauauauccaggcagca

SEQ ID NO: 2245771 - RNA, 76 nt, Homo sapiens
uaauccauaguauauuaguacucacugugugagguacuggguaauuacugaguaaaucacugaguaucuacgauua

SEQ ID NO: 2245772 - RNA, 61 nt, Homo sapiens
auuuguaaagugcuuaaaaguaugccuugcaaaggaaaugcuauguaagcauuuauuaaau

SEQ ID NO: 2245773 - RNA, 69 nt, Homo sapiens
ucagccugccaaaaugcugggauuacaggugugaaccaccauauuugacccucaguuuuggcucacuga

SEQ ID NO: 2245774 - RNA, 94 nt, Homo sapiens
uugguaucagcaugauacuggcuucauagaaugauuuagggaggauucccucuuucucuauccuguggaauagugucaacaggauugauaccag

SEQ ID NO: 2245775 - RNA, 63 nt, Homo sapiens
guuggaguguugauugcugccuuucacuuaacagugaauaagcaaaugcucuagcacuccaac

SEQ ID NO: 2245776 - RNA, 60 nt, Homo sapiens
uagaauugugacagggauuggccuuaugcgaucgcuguaaggcuguuaucuucacgucug

SEQ ID NO: 2245777 - RNA, 104 nt, Homo sapiens
cccucugggcgacuccggcucaucgauuccggcccagaggagcgcccccgggcgccgaggaugggcggagacgugcagccgccccugagaggucgcccagaggg

SEQ ID NO: 2245778 - RNA, 63 nt, Homo sapiens
uuuuuucccuucuuauauaguuggaaagaaaaagcucuucuucccuuagaagaaggggagaaa

SEQ ID NO: 2245779 - RNA, 89 nt, Homo sapiens
ggagaaucacuugaacccagguugcggagguugcagugugccgagaucacgccauugcacuccagccugggcgacaagagcaaaacucc

SEQ ID NO: 2245780 - RNA, 63 nt, Homo sapiens
acacucacauacauacaauguccaauaugggguuucuucuuacaaaguauggaauguuggugu

SEQ ID NO: 2245781 - RNA, 82 nt, Homo sapiens
ugugugugugugugugugugugugugugugugggcauguguguguguguuugugacacaaacacauauauuuuauauauaua

SEQ ID NO: 2245782 - RNA, 129 nt, Homo sapiens
cuugguuucuaucuccuacaggugagguaaugcuguagcugugaugguaucagcaaagaauaugccagaucagagcaauagggcuuauauucaaaugacuugagaaagauaauaaaguuaaugaacaag

SEQ ID NO: 2245783 - RNA, 73 nt, Homo sapiens
gcugaagucacuucuuaggaaaggagucaauaaaguuugaauuguucccagucaaacgaaggacuuccuuagu

SEQ ID NO: 2245784 - RNA, 59 nt, Homo sapiens
uguauguccaugagcacauguaucaguccuccaugcugagcuguuauuuugggcaugca

SEQ ID NO: 2245785 - RNA, 68 nt, Homo sapiens
agagauagccaaacuauaucaguccugaaaguggaauuuuaaggcuuugguagguuugguccauuucu

SEQ ID NO: 2245786 - RNA, 81 nt, Homo sapiens
ccagaagcaaacagcuguuuuugugggcaugugauugagguaccugagcagucuaugcuagaaggucaguugaagcucugg

SEQ ID NO: 2245787 - RNA, 59 nt, Homo sapiens
gauugaggcuguuaaucauaaaggcccuguagcuagaaugaugagcaauaguuuuaauc

SEQ ID NO: 2245788 - RNA, 77 nt, Homo sapiens
gugucauuuauguauggaagucaguuuguuggcucuaaaccugaggcuuacauuuucuuucauauuuuaaaugcuac

SEQ ID NO: 2245789 - RNA, 67 nt, Homo sapiens
guguugaaugccuagugugugacaggugcugugcuaagcauuucauauacauuagcacuuuuaacac

SEQ ID NO: 2245790 - RNA, 90 nt, Homo sapiens
accucucuagguaccucauguaaguggaaucgugcaguauuuguucuuuugugacugucuuauuucacuucgcaugguguccguaggggu

SEQ ID NO: 2245791 - RNA, 58 nt, Homo sapiens
ggguuucuggucugugugauggagggcagcgugaacccaucacuggagaaggaaaccu

SEQ ID NO: 2245792 - RNA, 63 nt, Homo sapiens
cugaggaguuuggguuguucaaagcuauguagcuuccuguuugcaaagccugaaacucuucag

SEQ ID NO: 2245793 - RNA, 80 nt, Homo sapiens
guuuauugacuguaacaaauaugccacucagggcaggauauugauugucagggagguuguauguaugcggggaaaugggu

SEQ ID NO: 2245794 - RNA, 70 nt, Homo sapiens
ugaaccauaugaaauugccguuuuugugggucagaaugauggccuaauauuggugguuuuaugugguuua

SEQ ID NO: 2245795 - RNA, 67 nt, Homo sapiens
guaaggagcaaugccucauucucacugaagagagacucacuguggauuuugcuuugcucuucuuugc

SEQ ID NO: 2245796 - RNA, 60 nt, Homo sapiens
auuuaccuaugaguuuguguuaguugaaacaauuggcagaaaucuuuauaguaaguaaau

SEQ ID NO: 2245797 - RNA, 66 nt, Homo sapiens
uuggccuugugacacagcugggccuauaguggagguuacacugugccaguuuugucuaagccccga

SEQ ID NO: 2245798 - RNA, 63 nt, Homo sapiens
gggcuuagagucuaggguuaggguggggaacauaagaaccauucaaaaccucugcuuaagccc

SEQ ID NO: 2245799 - RNA, 77 nt, Homo sapiens
uacccucuggauacccuuguucauaaagucuguauuguggcuuuuggugggggacguggggagguucagaguuggua

SEQ ID NO: 2245800 - RNA, 74 nt, Homo sapiens
gauaccgcuauacuggguuuaugccaagaacauuacacauguuuguggaaugcucauguguagacaacaguguc

SEQ ID NO: 2245801 - RNA, 56 nt, Homo sapiens
uugagauggaguuuugcucuugccgcccaggcuagagugcaauggcgccaucucag

SEQ ID NO: 2245802 - RNA, 56 nt, Homo sapiens
cucacagucucucccuaauuuuuaauacaaaagauggagauggggaagagugugag

SEQ ID NO: 2245803 - RNA, 84 nt, Homo sapiens
aagacaagaguuuagggugugguuuaucacucuuuucauuaaccugagucagauaaauccagauucugauguacuuuauguuuu

SEQ ID NO: 2245804 - RNA, 66 nt, Homo sapiens
uaauugccucaagugaucauggcaacuuccacuuucucuguaguuaucuucuccugaggcuaauua

SEQ ID NO: 2245805 - RNA, 129 nt, Homo sapiens
uucuuuaaaauuaaauuauaugugggugauucuauuccauaaaaauggcaacggcgaguuugagaaaaaucacauucucagugcuaucuuuuaugccuucucaugcauuaauuuaacuuuuuuaaggaa

SEQ ID NO: 2245806 - RNA, 94 nt, Homo sapiens
uuaauuugucugcaugauuggugagcagagggagaaguaaauuugucgcgaaagcuucauucuucuguuuuaacaacucacaaagagaaauuaa

SEQ ID NO: 2245807 - RNA, 70 nt, Homo sapiens
gguuuguccagagaagucauuacuucauuguagauuuaacuguggggcgaugcuuuauuugguucaaacu

SEQ ID NO: 2245808 - RNA, 59 nt, Homo sapiens
guagaaagcauuucagauuugcccccacccaagggacaaagaagcuggagugcuucuac

SEQ ID NO: 2245809 - RNA, 107 nt, Homo sapiens
acccucugggcauuccagaguauccuguugguccauuacauugaugacauguuuauaggacaugauuagcagaaaguggugaccauccugguugugcuucauagggu

SEQ ID NO: 2245810 - RNA, 62 nt, Homo sapiens
caggccuugggccuucgaccuggggagagucccugucuccuccaugagccguccagggccug

SEQ ID NO: 2245811 - RNA, 77 nt, Homo sapiens
agugcauaaaaaucaccuggggaucuuguuuacagauuggaauucacuugugaaguggauccugagguuguugcauu

SEQ ID NO: 2245812 - RNA, 61 nt, Homo sapiens
uggcuacagaaaguacuagugaaauauuagaucuaacucuauacuaauuuuucuguaguua

SEQ ID NO: 2245813 - RNA, 77 nt, Homo sapiens
cuuucaguucuaggguacaugugcacaaugugcagguuuguugcauauguauacaugugccauguuggucugacaag

SEQ ID NO: 2245814 - RNA, 60 nt, Homo sapiens
auuuucugccagugggaauguaaaggcuucauccuuuguauguaaccauuuggcaaaagu

SEQ ID NO: 2245815 - RNA, 71 nt, Homo sapiens
uguccaugagaugaauccacacaucacaaggcaauuucagauggcuucuuuguaguuuuuaucuugggaua

SEQ ID NO: 2245816 - RNA, 88 nt, Homo sapiens
uacacagaaaguguucacagugguugccuuccagaagaacuuugaacuuuuggaaauguuuaaaucaugugcaugaaugaucugugua

SEQ ID NO: 2245817 - RNA, 88 nt, Homo sapiens
agguauucuagccaccuuuuuaaagcacuuauccaacuguaauuaaauaaauguguaauuaguuggcugggugcgguggcccaugccu

SEQ ID NO: 2245818 - RNA, 76 nt, Homo sapiens
gcuuucaagauuuucucuuuauuuaucuauuacauuaauguggcugugguaugucuagauggggaagucuuugagu

SEQ ID NO: 2245819 - RNA, 61 nt, Homo sapiens
cauccuggcucuguuagaagaaccaguucagaagagagcugguuguuuaaggagccuggug

SEQ ID NO: 2245820 - RNA, 78 nt, Homo sapiens
cauguguguguaugcacaugugccugggugugugugucugugcaugucccugggugugugugcaugcaugugugcaug

SEQ ID NO: 2245821 - RNA, 80 nt, Homo sapiens
ggaucccaggaagggugccuucccucauuucccagaugaggacucugagaaugagaggggaaggccacuuguccaugucc

SEQ ID NO: 2245822 - RNA, 57 nt, Homo sapiens
cauucaaugugaugauagcccuguguuagccuuauauggucuuuauuguguugagug

SEQ ID NO: 2245823 - RNA, 68 nt, Homo sapiens
ggguacaugugcacaaugugcagguuugauacauagguauaccugugccauguugguuugcugcaccc

SEQ ID NO: 2245824 - RNA, 88 nt, Homo sapiens
agguauuacuggaauuuagagaguguuguccaaugucacaagaaccaagcagaaguugacaugaaggcaccucuguccaucaaggccu

SEQ ID NO: 2245825 - RNA, 79 nt, Homo sapiens
aguuuaggcucaauaaagcuuugagcuuugcugaguucaauacuuagcuucaaggccuuauuuuagucccuugugaacu

SEQ ID NO: 2245826 - RNA, 119 nt, Homo sapiens
gauauuacuccuaauaucacaguggguguacacucugugguauuauuuguacuauccuagagagauaaugcucccaguaucacaguggguguauacccugugauauuauucauaauauc

SEQ ID NO: 2245827 - RNA, 64 nt, Homo sapiens
agcugagaucucuugccugaacuccagaguuauacauucaacugcaguuggguaugucucaguu

SEQ ID NO: 2245828 - RNA, 80 nt, Homo sapiens
ggguguuucuauaagacuagcagcugaauugguugauuaaguaaaguaguuugcauugcuagucuggauggggaucaucc

SEQ ID NO: 2245829 - RNA, 68 nt, Homo sapiens
aguuaauuuuggggcugcaaaaguuugggaucuucacuuuucuuacuaugcuuuucuuagaauuaacu

SEQ ID NO: 2245830 - RNA, 94 nt, Homo sapiens
agcaggugucugagugagggacagcuaccucgaagcuggcucucaaagagcacaaacuugaaagcuaucucaaaucgcuauuuuggcaucugcu

SEQ ID NO: 2245831 - RNA, 67 nt, Homo sapiens
gugcaguuuacaguuacccaguaguaguucuuuguccagccucguggaguaucacugaagcaugcgc

SEQ ID NO: 2245832 - RNA, 60 nt, Homo sapiens
uaucuuaaccuuacugugucacagguuuuucauaugugacauagaguaguggugaggaug

SEQ ID NO: 2245833 - RNA, 78 nt, Homo sapiens
ugcuauugugaaugaugucgcaguaaacauacaugugcaugugucuuuauagcagcaugauuuauaguccuuugggua

SEQ ID NO: 2245834 - RNA, 58 nt, Homo sapiens
gcaacacuggcuuugugaauacaucuucuaaagggaauuauucacucuccagucuugc

SEQ ID NO: 2245835 - RNA, 59 nt, Homo sapiens
gcuguucauugagauuguuuccaaguauuugcuauuggaagucaugcugcaagaacagc

SEQ ID NO: 2245836 - RNA, 58 nt, Homo sapiens
aggaguguacuuuggucuuuugauacuauucucuugauagugaucacagucgucuccu

SEQ ID NO: 2245837 - RNA, 109 nt, Homo sapiens
cuggaaaaucccugagauaucagcuucaggcgaggcuuaauccaaggcugagagucugcauuucucuauuucuuggguuugccuugcugcugcaggccuuuuuuuccag

SEQ ID NO: 2245838 - RNA, 85 nt, Homo sapiens
ccauacgcuugcaugcauuuuuuauguuuuagguagugauauaaugcuugaauguaaauaauguacaggauaaaacaggcuaugg

SEQ ID NO: 2245839 - RNA, 71 nt, Homo sapiens
cuccaaaaucucagagccuaggguuuuucaaggauaguuuggcaggccaaggugcugcugauuaguugggg

SEQ ID NO: 2245840 - RNA, 55 nt, Homo sapiens
uguugaaauuauugaccugggagcagggugcuaguucuauggucagaauucaaua

SEQ ID NO: 2245841 - RNA, 62 nt, Homo sapiens
aaguuacccaguguauuaguguauuuuguguugcuaaacaaauacuugagacuggguaauuu

SEQ ID NO: 2245842 - RNA, 74 nt, Homo sapiens
aagaugaaagguauguuuucugugacauuuuucaauacucaguucugucacaacaaggaaaauauuuuucacuu

SEQ ID NO: 2245843 - RNA, 59 nt, Homo sapiens
cugauauuuuucuggcuugugugcuguuuguuuucaguuuauccccaugagaaugucag

SEQ ID NO: 2245844 - RNA, 70 nt, Homo sapiens
cugcuccucagcguugaguucugugcagaagggcucuucuggcaugggguaguagcgcugggcauagcag

SEQ ID NO: 2245845 - RNA, 70 nt, Homo sapiens
gaaagaaagugaagaucauacugguggagggugucaggaccaggcccuccauuaaggucugcacuguuuc

SEQ ID NO: 2245846 - RNA, 68 nt, Homo sapiens
caagacucuuguggcuucucuguccauacuguaagccaacaguuggacagacaagguuauagaucuug

SEQ ID NO: 2245847 - RNA, 87 nt, Homo sapiens
cauauuuucuuuguucauucauucuucaguggguacuuguguugcuuccacauuguagcuauugagaguaaugcugcuaugaaugug

SEQ ID NO: 2245848 - RNA, 101 nt, Homo sapiens
uguauauagauuuaaauaaucagcaccacuuacuguuaauuauuuuagccgugguauuggccuugacguaggaggauguugagaguuuuaggagaugugca

SEQ ID NO: 2245849 - RNA, 83 nt, Homo sapiens
ucuuaaccccuacaaaggacugaaacuggcugucagcucuggggcuugccacagucauagcagccuuuguuaacaaguuaaga

SEQ ID NO: 2245850 - RNA, 117 nt, Homo sapiens
ucuguucccccacuaggcuuugcugugagugccuggagggcagggacugggugaaccccggucaucucugcaccuccaggccugacacugggcagguggccaguaacuuggggcaga

SEQ ID NO: 2245851 - RNA, 76 nt, Homo sapiens
caggcccagcagggagaccaucucuuccuuaggacuugccuuaggucccauguccucccugaccacugauggccug

SEQ ID NO: 2245852 - RNA, 76 nt, Homo sapiens
aucaccuggaguagcccgucccuuccugaucugaaauucugugaucugucuagugggauugcugcuccuugguggu

SEQ ID NO: 2245853 - RNA, 60 nt, Homo sapiens
ggagauguuuaaccuuuuaucuguagcuaucugcuuaggaaugaaaggaaaggcaucuuc

SEQ ID NO: 2245854 - RNA, 68 nt, Homo sapiens
gauggcauggaaagcuuuucauaccgaggucugaacuccaagguguggagaccuuuccaccaaccauc

SEQ ID NO: 2245855 - RNA, 69 nt, Homo sapiens
cccuuacagggauuguuuuaaucaccugcuauucauccugcuggugagaaagggauuccuguuccaggg

SEQ ID NO: 2245856 - RNA, 65 nt, Homo sapiens
agccagugguuuuuagcuugcugggcuccgugggagugggaccugcugagcgagaccacuuggcu

SEQ ID NO: 2245857 - RNA, 85 nt, Homo sapiens
uuaacuggcauagcuauuagguuggugcaaaaguaacugcgguuuuugccauuacuuuuaaaucaaacuacaguaggccucuuaa

SEQ ID NO: 2245858 - RNA, 76 nt, Homo sapiens
gcgucacagugaaugucaucauugccuagcgacuguuccuccggcuuggcagagaaggagacauucaugaagaugu

SEQ ID NO: 2245859 - RNA, 58 nt, Homo sapiens
uguuucuguuguuauuguuuuggacuaaaaucagucccaguauucauuuacagaagca

SEQ ID NO: 2245860 - RNA, 74 nt, Homo sapiens
auugcucaggaagaccaaacuuugguuauaauagcuugcuaaaugugacaguuaguuugguguuaugagucaau

SEQ ID NO: 2245861 - RNA, 80 nt, Homo sapiens
uagauuggaaaucagagugaaacaugggagauuagaggcagcugugucucccagggccgccugauggauuccagcaucug

SEQ ID NO: 2245862 - RNA, 57 nt, Homo sapiens
acuggcaugagaugguaucucauugugguuuugauuugcauaucucuaaugaccagu

SEQ ID NO: 2245863 - RNA, 129 nt, Homo sapiens
uauucuguuccauuggucuacguaucuguuuuuaugacaguacucugcucuuuugauucuauagcucuguaguauaauuugaagucagguacugugauuccuccaguuuuguucuuuuugcucaggaua

SEQ ID NO: 2245864 - RNA, 59 nt, Homo sapiens
gugauaguucuuacuccaaagugccauuucuuagugauccuugaguucagagcugucau

SEQ ID NO: 2245865 - RNA, 129 nt, Homo sapiens
cucucacccucugaucuccugcugaggugucucauuggcuaaacucccauugcuagcaggcaugggagucuacugcuacaguucucaggaguuggccucccaagauacagagcaggguagaaaagggug

SEQ ID NO: 2245866 - RNA, 76 nt, Homo sapiens
ucgcucuguugcccaggcuguagugcaguggugcagucacagcucacugcauccuccauauccugggcucaagcga

SEQ ID NO: 2245867 - RNA, 65 nt, Homo sapiens
caucccuguaacuagcagccccuggugaguagaaagugacgaugggaacugcaagaugcaggaug

SEQ ID NO: 2245868 - RNA, 67 nt, Homo sapiens
acuaugcgcuaagaaggcagcacuggaaggcaaauacugauugaguuguugcauucuuggugugagu

SEQ ID NO: 2245869 - RNA, 55 nt, Homo sapiens
uugagauggagucuuguucuuucgcccaggcuggagugcaguggcaccaucucag

SEQ ID NO: 2245870 - RNA, 107 nt, Homo sapiens
gggcuccucaaguguggccagaauggacgcugaggcugaggaggugcugagagugagcgagggcugcuagcacauugucaccucucauuuccacaugagauaggucu

SEQ ID NO: 2245871 - RNA, 87 nt, Homo sapiens
uaaauaaaucagaucuaacauagucaugggguaauguugagaugcgacugaacucaauauuauuccccauacuauucuguguguuug

SEQ ID NO: 2245872 - RNA, 100 nt, Homo sapiens
gcuuaaaucacugaagaucuuggaggaaagcaauuacaaauaagcugguaguucugcuucuccauaauugcucuccuccaaggucuucagugauuuaagc

SEQ ID NO: 2245873 - RNA, 94 nt, Homo sapiens
uauauaagcucuaucauagacaaucaguuauugaagagacauuuuagaaaaagucugucuaauaauucugaucgucuaugacauggcugaugua

SEQ ID NO: 2245874 - RNA, 67 nt, Homo sapiens
aguggggaaauaucaauauuugaucaaauuaacacuaccuccuucccaguguugguguucacucacu

SEQ ID NO: 2245875 - RNA, 99 nt, Homo sapiens
aacagaaauuuauugucucacaguucuaaaggcaagaagucugagaucaaggugucaucaagguugguuccuuuugagggcugugaggaagaaucuguu

SEQ ID NO: 2245876 - RNA, 82 nt, Homo sapiens
caguacucaaauaugacuuaugcccauuuaaauugaacaaguucaucagggacugaugggcauaagucauauuugaguacug

SEQ ID NO: 2245877 - RNA, 91 nt, Homo sapiens
uccuacguugguucagaucaauagcucaauauguauggcugcaauguaaagcuacuauguagagauauugaauaucaaccucaacuuagga

SEQ ID NO: 2245878 - RNA, 55 nt, Homo sapiens
agauuucaguauuucuacuacggacaaucccagaguggauuuuagacugagauuu

SEQ ID NO: 2245879 - RNA, 83 nt, Homo sapiens
gguuaauaauaguggccagugucuauugguuuccugccuuuuggcuaaggacaaaccaauagacacuggccacuacuguaacc

SEQ ID NO: 2245880 - RNA, 62 nt, Homo sapiens
gaguaaaugucaaguacuuagguacagaauucaaucguauaauuauaguauuacauuuacuu

SEQ ID NO: 2245881 - RNA, 81 nt, Homo sapiens
cugucuaaacuuuuugaagugcugugggccaggcguguuggcucacgccuguaaucccagcacuuugggaggcugaggcgg

SEQ ID NO: 2245882 - RNA, 65 nt, Homo sapiens
augagauuugggaggggccaggaguggaauaauaugguuuagcuuuguccccgcccagaucucau

SEQ ID NO: 2245883 - RNA, 88 nt, Homo sapiens
gaagaggauggaguguggaagucuuugguauugguagucuuaucucagauuuauuguggcuagaauuuuuaccuacuucaugcucuuc

SEQ ID NO: 2245884 - RNA, 82 nt, Homo sapiens
aaaggcagguggauauaaaacacuggaguucagcaaagguaugagcuagagaguuuagugucaauaaauuacaccuuccuuu

SEQ ID NO: 2245885 - RNA, 56 nt, Homo sapiens
ugcuccguuuuugaccggcacugaugccacaucacauagcugaguaaaauggagua

SEQ ID NO: 2245886 - RNA, 93 nt, Homo sapiens
ucacucugucacaucauggcuugagugcaggugugcaaucaacagugagcuguaaccauacaccugcacucuagccugggugugauaguguga

SEQ ID NO: 2245887 - RNA, 80 nt, Homo sapiens
uuggagaguuuguacuucauugguucuacuuugucugagagcagauggagcccuaaagugaagcuauuauuauuuuucaa

SEQ ID NO: 2245888 - RNA, 73 nt, Homo sapiens
uggcauauaggcacacaacccuggaccugaggacuggucuaccuggguccacauuuggugcccauguguguca

SEQ ID NO: 2245889 - RNA, 57 nt, Homo sapiens
caccuggcuaauuuuguauuuuuaguagagacgggguuucucaguguuggucaggug

SEQ ID NO: 2245890 - RNA, 60 nt, Homo sapiens
gugacuaagauucuuugauaugaauuuaggucauccugaaauauaauaaauuuugguuac

SEQ ID NO: 2245891 - RNA, 109 nt, Homo sapiens
acuaguagugggauugcugggucaaaugguaguucuauuuuaaguucuuugagcaaucuucaaacugcuuuccaugguggcugaauugauuuacguucccaccaacagu

SEQ ID NO: 2245892 - RNA, 59 nt, Homo sapiens
augacauagaagcaauccccuaacaccaugucugacauaaaguaguugcucugugucau

SEQ ID NO: 2245893 - RNA, 71 nt, Homo sapiens
uugccuuuguuggaaacaagugcucggcaccacaaagaagaaccagcacucagaguuucucagcaaggcaa

SEQ ID NO: 2245894 - RNA, 84 nt, Homo sapiens
uuguaggcuguuuguaauaccugaggcuggguaacuuauaaggaagacagguuuauuuggcucgcgguuuugcaagcuguacaa

SEQ ID NO: 2245895 - RNA, 83 nt, Homo sapiens
uuagauuuguguuuuugcuucacauagugguuuugucguccuaauuagaucauaaacugcuugaggguaaguacaucagcuga

SEQ ID NO: 2245896 - RNA, 74 nt, Homo sapiens
ggguguacaggaccugugauucacgaguaacauuucuauagaauauuacacguaauaucacgguguguacaccc

SEQ ID NO: 2245897 - RNA, 66 nt, Homo sapiens
aguuauucagugaauuucaggucaagagucagucaugauuuuugcccugcaguacauaaauuggcu

SEQ ID NO: 2245898 - RNA, 91 nt, Homo sapiens
gaaucuauggcccauuacccagaggaacguuuggauugauuaucagaaguacacuucaaggaauucaaauuuucucuggagucauagauuc

SEQ ID NO: 2245899 - RNA, 71 nt, Homo sapiens
uauggcugugacuuaucuuguucuuccaaaauguuagacacaaguccauauaagucuguuucacugccaua

SEQ ID NO: 2245900 - RNA, 61 nt, Homo sapiens
ucagagcucugaccuugaggagagcagugaccccugaucccugacagggucugagcuuuga

SEQ ID NO: 2245901 - RNA, 87 nt, Homo sapiens
caguugaguagugguauguaggucuacgguacaaauacaaaaauaaguguuugagcaggucacaacaugcccacacaccgucaacug

SEQ ID NO: 2245902 - RNA, 67 nt, Homo sapiens
cuuuuaaugagguaaaggacaauguuuugauaaguauuaaugcacauuuauuuuaccuuucugagag

SEQ ID NO: 2245903 - RNA, 78 nt, Homo sapiens
aaaccauacuguguccuuuauacuguccaaaauuucauucuuccuuauuuucaguguggcaggcauagcuaguuguuu

SEQ ID NO: 2245904 - RNA, 58 nt, Homo sapiens
cuuugguguauuuucagagaccaaauuuuaggucaguggucucccagaaucacuaaag

SEQ ID NO: 2245905 - RNA, 83 nt, Homo sapiens
cugaugagggcuugggaugggggauucccugaugguuaauaucagauugacuagggacauucuuccacgccagccaaucucag

SEQ ID NO: 2245906 - RNA, 79 nt, Homo sapiens
gaauauaaacaguaggcuaaagcuauaucuuacccucaaaucugggugaaaugaucaguuugguuacugcuuuauauuu

SEQ ID NO: 2245907 - RNA, 99 nt, Homo sapiens
caggaacaggccauuuucacuucuuuugugauucuucaguuacuucaggccaucuggauguauaugugcaggucacaggggauaugauggcuuagcuug

SEQ ID NO: 2245908 - RNA, 57 nt, Homo sapiens
uuugcacuuuaauauaaugugaaugcaagcacagaaauauuguagguaaagugcagg

SEQ ID NO: 2245909 - RNA, 63 nt, Homo sapiens
cuauguguccauguguucuuaucauuuagcuccugcuuguaagugagaacaugugguauuugg

SEQ ID NO: 2245910 - RNA, 76 nt, Homo sapiens
guuccaaugugcuuggggcacaugaguaagggagggccacuaccaauuucaguccugaggcacauucuuuugggac

SEQ ID NO: 2245911 - RNA, 71 nt, Homo sapiens
guugagaguuucacauuuucaauuagaagaaacacuuuauggcuucucuuuggcauugccaaacugucaac

SEQ ID NO: 2245912 - RNA, 91 nt, Homo sapiens
uguguguguguguguguguguuggggcuaggggguugaguauguauggguuuuuaacuccauuuuagacccuagauaccaccacacccaua

SEQ ID NO: 2245913 - RNA, 61 nt, Homo sapiens
gguuaaucuggggaauaucacaaaucccuaagaagggaacugacuagauuccagauuggcc

SEQ ID NO: 2245914 - RNA, 56 nt, Homo sapiens
gagcuaguaagagguagaguuuggauuggaacccaugaaaucuggcucuacaguuc

SEQ ID NO: 2245915 - RNA, 62 nt, Homo sapiens
gguuacccagaguucuaggcauuggaaaguaggauuuucugauaaaguaacucuuggugauu

SEQ ID NO: 2245916 - RNA, 98 nt, Homo sapiens
acaccgucauuuauguguccuccucgagcagugcaagucuaucauccugggugcgggaauggaacauaacuauuuggggagauguuaaauggaagugu

SEQ ID NO: 2245917 - RNA, 83 nt, Homo sapiens
ggcuaagaaggcucaagagcugcaguuggcaagcugaagacccaggauagcugauggugcaguucuagccugagucugaagcc

SEQ ID NO: 2245918 - RNA, 66 nt, Homo sapiens
agugggcuugacugaaauaguucauuuaggaugagaacuuuguguauaguugagucaaguuucacu

SEQ ID NO: 2245919 - RNA, 70 nt, Homo sapiens
gagugaguuuugguaguuucugucuuuagauaauugaucuauauuaucuaagauuuugcuaagaucauuc

SEQ ID NO: 2245920 - RNA, 87 nt, Homo sapiens
ggauuacagccacuguagcagacuauuuugugauaauuucuaaguacagugaaauaugcgguuguacugauacuaugggugugaucc

SEQ ID NO: 2245921 - RNA, 58 nt, Homo sapiens
ucagauggcaucugagaguguuagauuuugcucaucugaugcugaggauggugucuga

SEQ ID NO: 2245922 - RNA, 60 nt, Homo sapiens
agaguuggucucugucacuguuaggcuagauauuugguuucacaguagcuggaucagccu

SEQ ID NO: 2245923 - RNA, 88 nt, Homo sapiens
uuagguuggugcaaaaguaauugcgguuuuagucauuaaacguauuaaaaguaauggcaagaucacaauuacuuuugcaccaaccuaa

SEQ ID NO: 2245924 - RNA, 70 nt, Homo sapiens
guguguguacaugcaugcaugggugugcgugcauaugucugcauauguauacgugugugugugcgcgugc

SEQ ID NO: 2245925 - RNA, 65 nt, Homo sapiens
augugagcuccuucauaaaaaggcacagaaugaugcaaauguaccuuuaaaagaaggguucacau

SEQ ID NO: 2245926 - RNA, 81 nt, Homo sapiens
acccuuuucaguuuaucaaggcaaacaugucaguaugucuuaauauugauaauguuaacuuuggucacuugguuauggggu

SEQ ID NO: 2245927 - RNA, 100 nt, Homo sapiens
uuauuccuucauguuucuaaugagggguauauauacagugugaugaaaacacuaaaaucacauuguauauguaccuaucauuggaaacaugaaggaauaa

SEQ ID NO: 2245928 - RNA, 59 nt, Homo sapiens
ggcagaauugcugaggaugcuagccuacuuuuuacacuagcuuuccuccugcaucuguc

SEQ ID NO: 2245929 - RNA, 76 nt, Homo sapiens
ccauauagggcaacuuccugacauugccauggcauauguaaacugucacggcacugguggaaguguagcagugugg

SEQ ID NO: 2245930 - RNA, 61 nt, Homo sapiens
aaugcuuauuuuuucagcuuugugggauuuaccaucuuccuaguaaggcacuauaggcauu

SEQ ID NO: 2245931 - RNA, 55 nt, Homo sapiens
ugcccuguaucccacuguuucacucaucuuccccagugaacgaugucucagggca

SEQ ID NO: 2245932 - RNA, 66 nt, Homo sapiens
ucaucacuucuacucaacauuguacuggagguccuaaccagugcaauaaggauguagaacugauga

SEQ ID NO: 2245933 - RNA, 68 nt, Homo sapiens
gagacaguugagcucaucuucaggggugaguuggaauucaccugauggagaaugaaguuuggcauuuc

SEQ ID NO: 2245934 - RNA, 56 nt, Homo sapiens
uugccauggaguagaauugaagaauuacugggaaauucaugcaauuccauggacaa

SEQ ID NO: 2245935 - RNA, 58 nt, Homo sapiens
gcccagaguggagugcaguggugcaaucauagcuuauugcagucuugaacuccugggc

SEQ ID NO: 2245936 - RNA, 65 nt, Homo sapiens
auggaaagcuguuccuacacaaggcaacaagcccagaacaggcugugugaggacaguuuaucuau

SEQ ID NO: 2245937 - RNA, 75 nt, Homo sapiens
uuuuguagcuaggcuguaauucgugaaguuucuauguucauccuagagacucauuuccauagucagcucauaaga

SEQ ID NO: 2245938 - RNA, 66 nt, Homo sapiens
caccuacauuuguaugaucauugcagcacuacugacaauagcaaagucauggaaucaaaugaggug

SEQ ID NO: 2245939 - RNA, 66 nt, Homo sapiens
gcucacaaagaaauuccugucuucucuuuagguaauccacagaugacuagaaauuauuuagugagc

SEQ ID NO: 2245940 - RNA, 57 nt, Homo sapiens
caaaagugguucuuauccuuuuauuuucucuucuuagaggagacagaaaagcuuuug

SEQ ID NO: 2245941 - RNA, 93 nt, Homo sapiens
uuucaccuauggcuguuugguuaauuucacuaggaaucacucucuaccuacaauguguauuccacaguuaacacagaccgaguccuggugggg

SEQ ID NO: 2245942 - RNA, 66 nt, Homo sapiens
ggggccuaguggaagguaauuggguaaugagagcaaaguuuucauuaauggguuagcuucagcccc

SEQ ID NO: 2245943 - RNA, 90 nt, Homo sapiens
cauuuccugauugguucuauauagcaggcaucuacaauuuucagauuuccaugaaaacugccuuccuuguaggugcagccaguggaagug

SEQ ID NO: 2245944 - RNA, 75 nt, Homo sapiens
agugguacugaggaguagggcacaaagccuugggcauagcugucaaggcuuuagcagcccaccccuuguaccacu

SEQ ID NO: 2245945 - RNA, 70 nt, Homo sapiens
gagccaguuuggcuaauuuuggcuaauuuuuguagaaacggggucucgccauguuggccaggcuggucuc

SEQ ID NO: 2245946 - RNA, 62 nt, Homo sapiens
uugguacuucaugcucacagauaaucagauugacuauccaguuuauuuguaauggagaccag

SEQ ID NO: 2245947 - RNA, 92 nt, Homo sapiens
guauuuaaaauuuuaaguaauuuguauuuuacccaugaacauuucauuuuguuuaauugggaucugauugcaguugccaagauuagaaauau

SEQ ID NO: 2245948 - RNA, 90 nt, Homo sapiens
gcacugcaggauucgguuugccaguauuuuauugaggauuuccgcaucaauguucaucagggauauuggccugaaaguuuuuguuguugu

SEQ ID NO: 2245949 - RNA, 62 nt, Homo sapiens
gcauagugaagcuguagguggauauggaggaugguagcccucuucucacagcucuacuaugu

SEQ ID NO: 2245950 - RNA, 55 nt, Homo sapiens
uugagauagggucuaccucugucacccaggcuggagugcagagggacuaucucag

SEQ ID NO: 2245951 - RNA, 98 nt, Homo sapiens
ugcauagauuugggcagacagagacauagauagguagauauagauagauagauaucuuauuggcucuguuucucugaagaaaccuaacacauccagca

SEQ ID NO: 2245952 - RNA, 99 nt, Homo sapiens
cccacagaucaguguuuaucugcauuagggugaagaccuggauauacauggauuaucaccagguugacagacccugaugcagguggagugagacauggg

SEQ ID NO: 2245953 - RNA, 60 nt, Homo sapiens
gcauuuugugauauccgaccaugaaguuaugucuauugugugucuuuuaucacacaaugu

SEQ ID NO: 2245954 - RNA, 80 nt, Homo sapiens
augguaauauguugaccaugccauuuuauaugcuaaauuuuaauuguauuguaguuugcuauggcaauaaauauuauuau

SEQ ID NO: 2245955 - RNA, 72 nt, Homo sapiens
augauccuuauugcuggauguauuacauguugaugucuccagccggacauguaauuccagcacaagcuucau

SEQ ID NO: 2245956 - RNA, 84 nt, Homo sapiens
cccaugucugauugguucucgguguuauuuaucuggaugccuuaaaauuucagaucaguuccacaagaacucuugagacuuggg

SEQ ID NO: 2245957 - RNA, 130 nt, Homo sapiens
ccugggcucaagugauccuuccaccucagccucucaaguaacugggacaauaagcaugcaccaccauacucugcucauuuuuauguuuuuuguagagacguugcgggggcgucucacuauguugcccagg

SEQ ID NO: 2245958 - RNA, 59 nt, Homo sapiens
gucggggaauuccugucagaguuccagaguuccauggugcuuuuucggaagucuuuggc

SEQ ID NO: 2245959 - RNA, 72 nt, Homo sapiens
uagacccguuuucacuaaauagaaacugaguuaucacuuuuugagaauuggugaaacacgauuuuggguuua

SEQ ID NO: 2245960 - RNA, 75 nt, Homo sapiens
ggggcuauugaaugguuggguuaaagaggauauggaaacugcauucuuuugugagucagccucuccugggguccc

SEQ ID NO: 2245961 - RNA, 67 nt, Homo sapiens
uccaagaacuuagucuguuugaggacauggaaauuuuaauucauugcucuuacagagugaguaugga

SEQ ID NO: 2245962 - RNA, 107 nt, Homo sapiens
ugcuggagauuuuauaggaugguucuuggguugauugauaaugccaaagcagcagagagcuuaaauggcauucuucugucagccgaggcauuugauaaauugaggca

SEQ ID NO: 2245963 - RNA, 130 nt, Homo sapiens
guggugagaaagggcagacuuguguugugccaguuuucaaagggaaugcuuccagcuuuugccuauuaaguaugaaguuagcucauuucuuuuuagugcugaauaauauuccacugucuggaugugccac

SEQ ID NO: 2245964 - RNA, 68 nt, Homo sapiens
uugcuugagccuggaaggcagagguugcagugaaccgagauugcgccauugcauuccagccugggcaa

SEQ ID NO: 2245965 - RNA, 60 nt, Homo sapiens
ucgugaagaaacaguuuucugucuuuauuacaaaguuauuuuugaaguguuucuucauga

SEQ ID NO: 2245966 - RNA, 75 nt, Homo sapiens
ggucguguuauugaaggacauucuaugguagaugagucccucaucacagguauguucuuucaaaggaucaugacc

SEQ ID NO: 2245967 - RNA, 59 nt, Homo sapiens
ggugacagagugagguccugucucaaaaaaggagggagagagucaucucuaucuguacc

SEQ ID NO: 2245968 - RNA, 70 nt, Homo sapiens
uugggccucacugcauggccacccauguuaucgaucaguugaucacauacuggcacaucaggaccaccaa

SEQ ID NO: 2245969 - RNA, 86 nt, Homo sapiens
uuguaugauacuaauuuauagcauuuugauccuguagauuuaucaggaucuaucaaggggcauguuguaaucuguaggucaaacaa

SEQ ID NO: 2245970 - RNA, 60 nt, Homo sapiens
aagagguaggaaauggucauuuuuaguuaaauauugaaaauggugccggguuuaucucuu

SEQ ID NO: 2245971 - RNA, 64 nt, Homo sapiens
guguguguguguguguguguguguguguguguguguguguguggaugugugcacgcgcacaugc

SEQ ID NO: 2245972 - RNA, 61 nt, Homo sapiens
gagaaugaugauuuccaauuucauccgugucccugcaaaggacaugaacucaucaguucuu

SEQ ID NO: 2245973 - RNA, 118 nt, Homo sapiens
aaaauuugauuuucuuauuguauuuucuaucucaguuaaugacccuaugccccuacuuacacaagaucagaagcaugagggccauuuauugagguauauauuuaucuaaugaaauuuu

SEQ ID NO: 2245974 - RNA, 60 nt, Homo sapiens
gagaaugaugauuuccaguuucauccaugucccuacaaaggacaugaacucaucauuuuu

SEQ ID NO: 2245975 - RNA, 120 nt, Homo sapiens
ucauauuccuaguggccugcugucuuaguuggggucuccccacaaguagaaccugagacaaggauuccagcucagguaguuugugggagaugauccuaggaaacaccacugaagauguga

SEQ ID NO: 2245976 - RNA, 64 nt, Homo sapiens
gcauagucuaugaugaguaacacuaagguuguucuucagcuugugauucuccaucauguugugc

SEQ ID NO: 2245977 - RNA, 56 nt, Homo sapiens
auuugaguucuaccaagccuuuccacagaaggauaaagugcucugggacucuaaau

SEQ ID NO: 2245978 - RNA, 65 nt, Homo sapiens
uagcucuauuagaagccgugggucauggaagagaaccguggaacccagcaacuaguguucagcug

SEQ ID NO: 2245979 - RNA, 60 nt, Homo sapiens
uugcugagucuuucuagguugcuguugauguaagcaguggccaggcugagagcuuagcag

SEQ ID NO: 2245980 - RNA, 64 nt, Homo sapiens
ggaucuauuuguugugucuaguucaauacuauagaguuggguuggucagaugcugaguggaucu

SEQ ID NO: 2245981 - RNA, 77 nt, Homo sapiens
uuauacacugugggaguguaaauuaguucaaccauaguagaaaacaguauguuuacacucccaccaacaguguauag

SEQ ID NO: 2245982 - RNA, 84 nt, Homo sapiens
cuacuguggaacccaguagagauugccgaauugcucagcuaaacguuuucaaauccgugacucucuauuugguuauucagucag

SEQ ID NO: 2245983 - RNA, 68 nt, Homo sapiens
ggucauggccuuuuuaucucaccaaguguggugccugcuccuucacaugcuuggagaaggcuaugacc

SEQ ID NO: 2245984 - RNA, 61 nt, Homo sapiens
ggauggcacucaaucaaguugagaagaacugacaucuuaacaauauugaguuguccuaucc

SEQ ID NO: 2245985 - RNA, 79 nt, Homo sapiens
gcccucgcuuucagagucaucugcccaaguacaguaaacagauccagcuacuacuuagauacuuugagaaguuuagggu

SEQ ID NO: 2245986 - RNA, 73 nt, Homo sapiens
uugcuauguaauuguguauauuucaguuuguauacuucauaucuccaugaaauugcacauuccuugcuggcag

SEQ ID NO: 2245987 - RNA, 101 nt, Homo sapiens
ugaggcaggagaaucgcuugaacccgggagguggagguugcagugagccgagaucgcaccauugcacuuccgccugggugacagggcgagacucugucuca

SEQ ID NO: 2245988 - RNA, 62 nt, Homo sapiens
cucuggugugggugcuaugauauauaaaaguaaauucaauauuuggcauuaugucaccagag

SEQ ID NO: 2245989 - RNA, 71 nt, Homo sapiens
ucucugucuuugccuaaguuugucaaugucacuaccaucccuuacagaggcuaauuuccccaaagcagaga

SEQ ID NO: 2245990 - RNA, 79 nt, Homo sapiens
aggcuggagugcaguggcacaaucuuggcucacuacaaccucugccuccuggguucaagagauuccccugccuuagccu

SEQ ID NO: 2245991 - RNA, 93 nt, Homo sapiens
aauuugauagucuuugauagcaauaugacauugcuacauccaagugugggagucaguacacuuauauugcgcauaucuuggacauuuuagguu

SEQ ID NO: 2245992 - RNA, 61 nt, Homo sapiens
agcuguguucucgaggcgggggagggcucuuggaaggucuccuggcuagaaggacacagcu

SEQ ID NO: 2245993 - RNA, 64 nt, Homo sapiens
uauuaauuacccagcaauucucucguauugcucugaaggaauaccugagacuggguaauuaaua

SEQ ID NO: 2245994 - RNA, 91 nt, Homo sapiens
ucauaauugccacuuuuucauauaugguguucagaaucaugauaauuauaaagcugaugauggaggccgugauggacguggcugucugugg

SEQ ID NO: 2245995 - RNA, 107 nt, Homo sapiens
guauauaugguauaaagggugauuagacaguguguguauauaugguauaaagggugauuagacuguguguguauauaugguauaaagagugauuagacuguguguau

SEQ ID NO: 2245996 - RNA, 87 nt, Homo sapiens
gcccggcauggugccuacucucugccaggaaugaagaagccuaggacucuaugccccaucccuggaggaguauggccuauucagggc

SEQ ID NO: 2245997 - RNA, 70 nt, Homo sapiens
guuuauuucuacuauuuugccugauuuuuuucuaaucagaaauaaggcaaguuuuuaguggacaugguac

SEQ ID NO: 2245998 - RNA, 73 nt, Homo sapiens
gggggcucgugccagcccugaaggugguuggaaggucuuuuuguagcagccaggaagggcuggcucugcuucu

SEQ ID NO: 2245999 - RNA, 64 nt, Homo sapiens
auugugaauagugcugcauuaaacauacgugugcaugugucuuuauaguagcaugauuuauaau

SEQ ID NO: 2246000 - RNA, 87 nt, Homo sapiens
gggaacagguggacuuaagagagcccugacaugggcagauagcugccuuucaugugcaugcuuucuuauguguuuuagccuuuucuu

SEQ ID NO: 2246001 - RNA, 72 nt, Homo sapiens
uuguuuuggagaugagcuaaaaggacacuuuauauuuuccccuauccaacacaagcguuaucuucagaacaa

SEQ ID NO: 2246002 - RNA, 59 nt, Homo sapiens
uagaagcugagaauguccucagguugccagucagcaugaaaguggggaccucaguucua

SEQ ID NO: 2246003 - RNA, 68 nt, Homo sapiens
agguggguggaucacuugagguuagaaguuggagaccagccuggccaacauggugaauccacauaucu

SEQ ID NO: 2246004 - RNA, 129 nt, Homo sapiens
auuuuugacaaagaugugaaggcuauucaaugggaaaaggauggucuuuucaacaaaugguauugaaacaauugaauguccauaugcagaaaugaacuuugaccauaagcucacaucuuguacaaaaau

SEQ ID NO: 2246005 - RNA, 64 nt, Homo sapiens
guagugcaguuugagaaucagugggugacagcagauacacagggguuccaaagcuugcaguuac

SEQ ID NO: 2246006 - RNA, 78 nt, Homo sapiens
ggcacggcgaccuuaagucccuuguccagggccccacagauggggagacugaggcacggcgaccuuaagucccuuguc

SEQ ID NO: 2246007 - RNA, 60 nt, Homo sapiens
aggaaaaaagaucagaaagaaauaaaccaaaauguuaacgugauugugaucuuuuuucuu

SEQ ID NO: 2246008 - RNA, 70 nt, Homo sapiens
aauauagaaggagcuaagagaucauacaugaauaauuggcacauguggacauuucuuauuuucucauauu

SEQ ID NO: 2246009 - RNA, 79 nt, Homo sapiens
ggagugcaguggcacgaugaucugggcucacugcaaccucugccuccuggguucaagagauucucgugccucagccucc

SEQ ID NO: 2246010 - RNA, 67 nt, Homo sapiens
gaaguggguucugcuguaaccagacaguugcauucccaaggagcuguguguuaucagaaauugcuuu

SEQ ID NO: 2246011 - RNA, 119 nt, Homo sapiens
ccucuguggaaaugaguaaugcugccuuaccuacuuaccacaugucaucuuguauccuuguuaagaguagggcccauggaaguaaucaugagguagcacauaccauauuaccacugagg

SEQ ID NO: 2246012 - RNA, 65 nt, Homo sapiens
cuaguuuauuugcauagaggugaguauaguauuuugugauagcuuuuucauuucugugacacuag

SEQ ID NO: 2246013 - RNA, 82 nt, Homo sapiens
uacaaagaagcugugauuauccacgucuuugugaaugagaaagugacauucaacggacuuacuggagaugauggaauuugug

SEQ ID NO: 2246014 - RNA, 59 nt, Homo sapiens
caccagaagaaucagaucacacgugggcuuugagaaugagugcaagguuuuucugagug

SEQ ID NO: 2246015 - RNA, 69 nt, Homo sapiens
ugcugcucuggccucuggaaguuucuguuugcugaaagcuaguguucaccagaggucaugaggccagca

SEQ ID NO: 2246016 - RNA, 106 nt, Homo sapiens
ucuuccucaugggguccccuuuuuucuuagcaacauucagcucagguacagaugagaauuauguucaucuagggugaguguggccagaaggcagggcaggggaggg

SEQ ID NO: 2246017 - RNA, 58 nt, Homo sapiens
uucagaguagagcgacuucuccugcaaccaaguuuuaagagagguuuucuaugaugag

SEQ ID NO: 2246018 - RNA, 104 nt, Homo sapiens
cgaguuagcugaccucaaucaagguuucaaaaugaacucauucuuauggggucuaaucagaugagagcugcauucuugaaagcuugauuagacuguuagacuug

SEQ ID NO: 2246019 - RNA, 63 nt, Homo sapiens
uacucuccacuaggcaaugucuggagacauuuuugguugucaugacuugagagugggagagua

SEQ ID NO: 2246020 - RNA, 56 nt, Homo sapiens
ucaggcaugcagcaaugcagugacaguaacacaugcagauggaaggcauagccuga

SEQ ID NO: 2246021 - RNA, 94 nt, Homo sapiens
cccaaauaagaaacagagugggucccacgauguaccugucugaaaugcaaaugcagcuggacuguaaauuggggacucuuugaucucuuguggg

SEQ ID NO: 2246022 - RNA, 59 nt, Homo sapiens
gagacguguaggaggcagagugaaaggcuuguuguuagagcugugcuuaauacacuuuc

SEQ ID NO: 2246023 - RNA, 56 nt, Homo sapiens
uaccucaagcugaacucugccagaaacccauggccccuugggucaccuugcaggua

SEQ ID NO: 2246024 - RNA, 100 nt, Homo sapiens
agccauaaaaaagaaugggcucaugucuuuugcagcaacauggaugaaacuggaggacacuucauccauguugcugcagaagacauguaaacaaugugcu

SEQ ID NO: 2246025 - RNA, 65 nt, Homo sapiens
aaugaccagcauguuuauuuaguacauaauuauauguguauacugucuaauauguuguguucauu

SEQ ID NO: 2246026 - RNA, 127 nt, Homo sapiens
gccucacaaagugcugggauuacaggcgugagccaccgcgcccggcugaaagucagguucuugaaaaaaaucugguguguggccgggcacaguggcucacaccuguaaucccaacacuuugggaggu

SEQ ID NO: 2246027 - RNA, 60 nt, Homo sapiens
uuauugggcuucucagaauagaggggcauugguuuccucucuggaauuaaagcccaauaa

SEQ ID NO: 2246028 - RNA, 80 nt, Homo sapiens
gaguaccuagcagacaugggcugaaccacacaaaaucaucuauaaguggucuccacaugcuuugcucuguccaagcacuc

SEQ ID NO: 2246029 - RNA, 69 nt, Homo sapiens
aggcuaccuugugagguugauaugaagauuaaauuaauuaauucacauaaagcacuuagaacaaagccu

SEQ ID NO: 2246030 - RNA, 99 nt, Homo sapiens
gggcaagauaaagaaauaaaggguauucaaauaggaagucaaauuaucuguuugcagaugacaugauuguauauuuagaaaaccugaucuuaucagccc

SEQ ID NO: 2246031 - RNA, 72 nt, Homo sapiens
uuagaucuaccugucauacaaggccuuaacaaagauacaauuuauggcccauauguuuggcuauaggucuaa

SEQ ID NO: 2246032 - RNA, 128 nt, Homo sapiens
gccaauuuaaauuugaauuucagauaaaugauacauuuuuuaguacaagucugucccaugcaauauuugggaucaacuuauacuaaaauuguuuuguuguuguuucucugaagucaaauuuaacuggc

SEQ ID NO: 2246033 - RNA, 66 nt, Homo sapiens
uuccaauguuccguguugcagucccuauaagacucauaugacugaauguauacggaauaucuggaa

SEQ ID NO: 2246034 - RNA, 57 nt, Homo sapiens
cuuacagauggauggcagcuggcucuucaccagaugcccaaguugucauuuuguaag

SEQ ID NO: 2246035 - RNA, 67 nt, Homo sapiens
guuaagaauggggaauagccacagacagcaaggagcuaccacguuugugcuaacuuuaacucuuaac

SEQ ID NO: 2246036 - RNA, 69 nt, Homo sapiens
cgagagugaccuagaacucuaaugccugucuugaaccaggcgggauuauucugggucaaccaguuuucg

SEQ ID NO: 2246037 - RNA, 59 nt, Homo sapiens
auagagcucaucuguauaggaaagcuguuucagugacuucccguacugguguugccuau

SEQ ID NO: 2246038 - RNA, 62 nt, Homo sapiens
auuucauaucccgagacuuugcugaaguugcuuaucagcuuaaggagauuuugggcugagau

SEQ ID NO: 2246039 - RNA, 83 nt, Homo sapiens
aacucacuugguuucagcuaguggcaaaaagaaggguguauuggaucuggaauucuuagguuaaggcugagagaaugugaguu

SEQ ID NO: 2246040 - RNA, 95 nt, Homo sapiens
auuuucucccauuuuguagguugucuguucacucugauaguaguuucuuuugcugugcagaaguguccaacgaugauagacuggauuaagaaaau

SEQ ID NO: 2246041 - RNA, 55 nt, Homo sapiens
guguguaaauggcagugagcucuguaguuagucaggaucauggacaauuacacau

SEQ ID NO: 2246042 - RNA, 68 nt, Homo sapiens
uuguuuugcaauagguuguggggagguccuuuaccacagggccuuugccaagcacugauguagagcaa

SEQ ID NO: 2246043 - RNA, 69 nt, Homo sapiens
aauggcauugguccuuuuggauaaagucucuccuuaccugagucuggauuccugauugacagugccauu

SEQ ID NO: 2246044 - RNA, 63 nt, Homo sapiens
uguuagcuauggccauuacuaagaauguuuuauuaaacacccacuaggauggcuaugaugaca

SEQ ID NO: 2246045 - RNA, 84 nt, Homo sapiens
gcaauagccccuuuugagggagcauuuguuuugagggucuuucaucuggagaauaaaucucuccucuucagcuuggcugguugu

SEQ ID NO: 2246046 - RNA, 56 nt, Homo sapiens
ccagggaggagcauuucauggugugugucuugacaacaugacaaugcuaguccugg

SEQ ID NO: 2246047 - RNA, 64 nt, Homo sapiens
cucauccagucaagcuuuuagaugacugcaagccacaaccagcaucugauugcaacugcaugag

SEQ ID NO: 2246048 - RNA, 76 nt, Homo sapiens
cauuagaguaaauguccuagcuucuugguacuacuagcaggagugggauucaacuaguugguacuuuuauucagug

SEQ ID NO: 2246049 - RNA, 71 nt, Homo sapiens
uguuaucaucagccauacaacguaugcauguaugccugaugcuaacauauguuguaugguugaugguaaca

SEQ ID NO: 2246050 - RNA, 71 nt, Homo sapiens
uccuagaauagcagacauuucaaggcaggauuugucucucuucugaacugaaauaaucugcuacuuaagga

SEQ ID NO: 2246051 - RNA, 64 nt, Homo sapiens
ucaugugggcuauuguuguaucaaccauuuguuccauuuuuauuggugaauaguguccccauga

SEQ ID NO: 2246052 - RNA, 99 nt, Homo sapiens
ugguaccaucuguagcuguugacacccgugcucccuccagcugcucagcuuccagggcuggagcugugaaaguggcaugagggucaucauaucauacca

SEQ ID NO: 2246053 - RNA, 130 nt, Homo sapiens
cuccugggcucaagcaauccucuugccucugccucucaaagugcuaagauuaggcugggugcaguggcucacgcuuguaaucucagcacuuuucggaggccaaggaggauggaucacuugaggucaggag

SEQ ID NO: 2246054 - RNA, 62 nt, Homo sapiens
guuagggggaauucucuccucaguguuuuggaauaauuucaggagaauugguucuucuugau

SEQ ID NO: 2246055 - RNA, 56 nt, Homo sapiens
ugcauaggagcagggucuauguccaucuuguucagguauaggccuagcuccuagca

SEQ ID NO: 2246056 - RNA, 70 nt, Homo sapiens
ugugauuaaguuaggauuuugagauagagaaauuauccuauauuaucuuggugggcuuaauauaauuaca

SEQ ID NO: 2246057 - RNA, 62 nt, Homo sapiens
cuccagggauucagauaucaauauaccacaguucguucuuucuggaguuugaguucuuggag

SEQ ID NO: 2246058 - RNA, 64 nt, Homo sapiens
gaggucacugccuugguuucaagaggccaagcuaucucuuccuggaguguuggggcaggaucuc

SEQ ID NO: 2246059 - RNA, 96 nt, Homo sapiens
ccauccggaucaguuaucauucuuuucuggcaggccuuauuauauugaucuccuuauuuaugagacuagaagagaauaauaaucgaugcuuugugg

SEQ ID NO: 2246060 - RNA, 84 nt, Homo sapiens
uuuguauaaugucuuuguagaggaauggcuccaccauagcaugcuagugaccuugcauucuucuacauagcucacguaggcaaa

SEQ ID NO: 2246061 - RNA, 56 nt, Homo sapiens
aucuccaaauacagucauauuagggguuagggcuucaacauaugaauuuuggagau

SEQ ID NO: 2246062 - RNA, 62 nt, Homo sapiens
uugacuauaucucuguauaaacuuucagugauuauucuagggguuacgguauguauaguuaa

SEQ ID NO: 2246063 - RNA, 82 nt, Homo sapiens
acagucugggcauauuagaaauguuuacucacccccuuccauuccuggaagcagggagaaauuuuucuucagucuucacugu

SEQ ID NO: 2246064 - RNA, 98 nt, Homo sapiens
gaugugcugcugaacuagguuugccaguauuuuauugaggauuuuugcauugauguucaucagggauauuggccugaaacuuccuuuuuugguguguc

SEQ ID NO: 2246065 - RNA, 66 nt, Homo sapiens
gguuagacucauuuuggucaaggauuuaugaauauugguauuuccauuccauaaugagguccaauc

SEQ ID NO: 2246066 - RNA, 70 nt, Homo sapiens
ccuguaaucucagcuccucaugaggcugaggcaggagaaucacuugaaccuaggagcuagagguugcagg

SEQ ID NO: 2246067 - RNA, 107 nt, Homo sapiens
uggauauggauaucuauaucuggauaucuauauguggauaucuauaucuggauaucuauauguggauaucuauaucuggauaucuauauguggauaucuauauauca

SEQ ID NO: 2246068 - RNA, 57 nt, Homo sapiens
cacauaggcuguaugguacagcccauggcuccaaacuacaaaccuguacagcaugug

SEQ ID NO: 2246069 - RNA, 83 nt, Homo sapiens
agcaugaagcgguguugaauuuuguugaaggccuuuucugcaucuauugagguaaucauguggucuuugucauugcuucuguu

SEQ ID NO: 2246070 - RNA, 79 nt, Homo sapiens
gcauagacccuguaacauacaagugguucaauaaauguuagccaucaccauuguaguuacagaaaaggggucccaaugc

SEQ ID NO: 2246071 - RNA, 116 nt, Homo sapiens
gggagacugaggcaggagaauugcuugaacccgggaugcggagguugcagugagccgagaucgcgccauugcacugcagccugggcaacaagagcgaaacuccaucucucucucuc

SEQ ID NO: 2246072 - RNA, 65 nt, Homo sapiens
ucaguggauuggauggauaaugcccauccacacugggagggcaaucuacuuuaccagucuacuga

SEQ ID NO: 2246073 - RNA, 79 nt, Homo sapiens
ucugaauaccugaggcaaaaacacugauuaggcugugucccccuguuagcuuuguggggucuuuccucaaauccucaga

SEQ ID NO: 2246074 - RNA, 63 nt, Homo sapiens
caguacccucaggcuuacuaggguggggaaaaaucccacccuggagaauuugaggucagacug

SEQ ID NO: 2246075 - RNA, 57 nt, Homo sapiens
guguagguaagguuaugguugacuagaaagcagaaaugguuaccagcauaccuacac

SEQ ID NO: 2246076 - RNA, 55 nt, Homo sapiens
agcagguauucgggucaugggggcagaucccucaugaacagcuuggugcucugcu

SEQ ID NO: 2246077 - RNA, 83 nt, Homo sapiens
accuguucccuuuuguaugauaucugaaucuaggcaacuugaugagaaagcuugccuagauccaaauauggugcaaaauaggu

SEQ ID NO: 2246078 - RNA, 68 nt, Homo sapiens
aaaacaugaaauucuagcugaacccgguuaugcugguauauagugggauuauugugauuucauguuuu

SEQ ID NO: 2246079 - RNA, 79 nt, Homo sapiens
acauugccuaaguccccugacagaggggaggaaaauguaugcaaaaauccuaccccacugcgggagacaaaggagaugu

SEQ ID NO: 2246080 - RNA, 96 nt, Homo sapiens
ugaguuuuugucuucaugaauuuggugagaaaucaguuguuuauuuuaugaagguuuuauuauaggcaacgcuucuuucucagguucugacacuca

SEQ ID NO: 2246081 - RNA, 58 nt, Homo sapiens
ugagcugagaucuuaccacugcacuccagucugggugacagagugagaccuugucuca

SEQ ID NO: 2246082 - RNA, 57 nt, Homo sapiens
uggaaaugggugggcagaaaaaaguggaacuaccaacuucuaguacuucuguuucca

SEQ ID NO: 2246083 - RNA, 72 nt, Homo sapiens
cugcuccagccccuggugcacagggugaugagcaauuaaacagguuugcuuugugcuacugaguuggggugg

SEQ ID NO: 2246084 - RNA, 82 nt, Homo sapiens
accaaacgcaagugaugacagcugacucccuugcuauaguaaacucugaguaaauauuuuggguuguuuucauuuguguggu

SEQ ID NO: 2246085 - RNA, 63 nt, Homo sapiens
gacaaauuuguaaauggguauucagugggaagugacugaacaaaaccauucaacagauuuguc

SEQ ID NO: 2246086 - RNA, 88 nt, Homo sapiens
agaaugguauaguauaauauucuuugaacaguuuuccugugcauaguaaaauaccuauggaagaauugucggggaugugcuccauucu

SEQ ID NO: 2246087 - RNA, 73 nt, Homo sapiens
gcccgaggccugcaguucuccauguccucuccuugaccccgcccgaggugcaaacuccaggucucuucagggc

SEQ ID NO: 2246088 - RNA, 65 nt, Homo sapiens
cucuccacagaagaccaagaaagcuuccaucucucauggagaucuuuguuaucuuuugauaagag

SEQ ID NO: 2246089 - RNA, 56 nt, Homo sapiens
ucaacaucaaccaugaggguuggaaucaacuucuucuaaacuccaguuaauguuga

SEQ ID NO: 2246090 - RNA, 68 nt, Homo sapiens
ggggcuuugauuacccauagugcaguuaguaaagguuugcuggcaugcauuguggguaauuaaguccc

SEQ ID NO: 2246091 - RNA, 104 nt, Homo sapiens
guauucuacauucuccauugugaagucuuucuaaaugucagucacauagagagcucaguggcagcgugaaagacuuuuucauuucuugcaggaugaagauaugc

SEQ ID NO: 2246092 - RNA, 55 nt, Homo sapiens
uuauggcugaauaaauuaugguauauucguaccaugaacuaguuugcagccauga

SEQ ID NO: 2246093 - RNA, 67 nt, Homo sapiens
caguccccauccagcccagugggauugcaggggcccagcugaggaucccaagaugagaugggggcug

SEQ ID NO: 2246094 - RNA, 57 nt, Homo sapiens
gggggugagcucaguauuucauaaacaacuucaugagguuguuuuccugaguccucc

SEQ ID NO: 2246095 - RNA, 64 nt, Homo sapiens
gcuuggaccuggaaggcggagguuacagugagccgagaucacaccauugcacuucagccuaggc

SEQ ID NO: 2246096 - RNA, 115 nt, Homo sapiens
uguaaguuguauuccuagguauuuuauuuucuuuauagcaauuaugaaugggaguccacucauaauuugguucucuguuuauuuuugguguauaagaaugcuugugauuuuugca

SEQ ID NO: 2246097 - RNA, 62 nt, Homo sapiens
cagcaggaauguguaaugcuaggagugagugaaguuacucagagauuagcacauguuuguug

SEQ ID NO: 2246098 - RNA, 78 nt, Homo sapiens
uggcugaguugucccaguuggguauugaauucaugguaugauuuauuugcaggauugggacuggauaaaacucaguca

SEQ ID NO: 2246099 - RNA, 76 nt, Homo sapiens
uuuuucagcuacguuuuuagaaagacauuuuaaaauuauuuaugcuguuuucuggagauuucuguggguugaaaga

SEQ ID NO: 2246100 - RNA, 98 nt, Homo sapiens
agguauacuugacagugagcucugauuaguauaauuuaucacuguuuugcacagagaugauauuauucuagcccagagcaaacacauuuaaugugcuu

SEQ ID NO: 2246101 - RNA, 129 nt, Homo sapiens
caaaacgaugagguugaguguguguguguguaaccuagaaucuaggucuucuuagauugaaaaucaucgcaguucuaaggaacucugauaucuggaaaaauccauacucaggcaccaaucagucauuug

SEQ ID NO: 2246102 - RNA, 103 nt, Homo sapiens
caggcauguuguuucuuaaacaguuaaauggcauuugccagggcaaagagucccaguucauuguccuuucaaaugcauucgagguuuauucugcauggcacug

SEQ ID NO: 2246103 - RNA, 89 nt, Homo sapiens
auuguguuuuaaaauuggcauugaguuucaaaucauacuguauaaacugccagugguaugacacucaguguuuauuuuaaagccaugau

SEQ ID NO: 2246104 - RNA, 91 nt, Homo sapiens
gugagaacuagaacuggcaucuaaauacuugauguucuaaguucaaagagacaccaguaauuagagccaguauauuccuucuaggacuuac

SEQ ID NO: 2246105 - RNA, 89 nt, Homo sapiens
gcgggaacaucaggauggauggacagacacuggccuucuggaagguucaacuccagcagggaagcugugcuguuucacaaauuggcugc

SEQ ID NO: 2246106 - RNA, 113 nt, Homo sapiens
uuugaagggugugaugcuuggaagcauuuucugugcuuugaucacuaugcuaggacacauuaggauuggucauggaaauagaaugcaccaccaugagcaucaucaccuacaag

SEQ ID NO: 2246107 - RNA, 93 nt, Homo sapiens
aaauuaacccauauuuaguaaggcauucucaaacuaguucucgaaggguuggggguggauuugaagaaugggaacuaaaguuauaguuaauuu

SEQ ID NO: 2246108 - RNA, 92 nt, Homo sapiens
uuggagacuuuucacacauuagggguaaucucuuaacccauuggcauuugaauaugauggcaagaaggauuuauuccuugaaaauacuucaa

SEQ ID NO: 2246109 - RNA, 129 nt, Homo sapiens
accucaaaucaucaggcauuaguuagagucucauaaggagcacacaaccuagaucccuugcaugugcaguucacaauaugguuugugcuccuauaagaaucuaaugucauuacugaucugacaggaggu

SEQ ID NO: 2246110 - RNA, 80 nt, Homo sapiens
gacaaucagaauaugcaucuaucuagugagcagagggaugacuuugaauagaauggaaggcauguuugcccugagcaguu

SEQ ID NO: 2246111 - RNA, 60 nt, Homo sapiens
uuugcugaauagucaauguuggauuguucuuccuuacgagcacuaauacuauucaacaag

SEQ ID NO: 2246112 - RNA, 98 nt, Homo sapiens
acuguauuauagcaaguugaucuuuaggacacacauuaaggagaaugaacauuuucagaguggccucucuugaagaacaaccauuugcuuggaacagu

SEQ ID NO: 2246113 - RNA, 59 nt, Homo sapiens
agcuucuauuaaguuguagcuacaaauacacuguguacagugacaacuugguaggaguu

SEQ ID NO: 2246114 - RNA, 73 nt, Homo sapiens
uaucaucacuucuguucaaccguguacuggaaguccuagccaguaucacaggcaaaacagaauaagaaagaua

SEQ ID NO: 2246115 - RNA, 57 nt, Homo sapiens
cagacagggagggagcgcggcugggccagaaggcugaucaccgccugcccccugcug

SEQ ID NO: 2246116 - RNA, 87 nt, Homo sapiens
gauuuuuagcuggaauacuauucugugcuggaagcaguuaccucugucacuccacauauuagaauggauuuuuaagguguaaaaauc

SEQ ID NO: 2246117 - RNA, 55 nt, Homo sapiens
cguuuugaucagugauggaccgcauauacaaugguggucccauaagauuauaaug

SEQ ID NO: 2246118 - RNA, 95 nt, Homo sapiens
gggcagggcauuuucacuucuuuugugauucuucaguuacuuuaggccaccugggcguauaugugcaagucacaggggacgugauggcuuggcuc

SEQ ID NO: 2246119 - RNA, 67 nt, Homo sapiens
uguguauuuuccaagcauuuucaugccaguaaaacccuucugugagaacagcagcuugggacacaca

SEQ ID NO: 2246120 - RNA, 73 nt, Homo sapiens
ucuagugccauacugaauuuuggcuacaaaacucacaauuagucagcuauuggcaagauuuguauugccugga

SEQ ID NO: 2246121 - RNA, 70 nt, Homo sapiens
uaagacuguuggcaauuuuugcacauugacuuuauaucuugagacuuugcugaaguugcuuaacagcuua

SEQ ID NO: 2246122 - RNA, 76 nt, Homo sapiens
gagaaguacacauuucuuccaaguaccagaaagauauaaaguguuuaucaggccuuuggaaaaaugaagugcucuu

SEQ ID NO: 2246123 - RNA, 69 nt, Homo sapiens
gggaacuggaguaaaugucacuguugcugugcuuuagcaaagagacugguggcauuuugccccuguccu

SEQ ID NO: 2246124 - RNA, 77 nt, Homo sapiens
gagaagugguuguuuccagguuugaaaaauuucacaguauuauuuuaagcuacaagagacauaugccuaacuuccuc

SEQ ID NO: 2246125 - RNA, 88 nt, Homo sapiens
uauuuuuugaggaugucaacaaaauuauucuaaguccuuuguggauuggcaaaggaacuggaauauuuugaacaauuuuuaaaaagug

SEQ ID NO: 2246126 - RNA, 59 nt, Homo sapiens
guuguuggauuugguuagcuaguauuuugauaaagauuuuagcauccauguucaucaac

SEQ ID NO: 2246127 - RNA, 84 nt, Homo sapiens
gugugagaggauacucuguugucuggccuuccugucugccuauggccaguccugcccaggcugacagaaucaucugccucacau

SEQ ID NO: 2246128 - RNA, 62 nt, Homo sapiens
uuccgcuguaguuguugguaccuugagcucagguucaccuugacucuaguaacugcuuggaa

SEQ ID NO: 2246129 - RNA, 78 nt, Homo sapiens
ucauuauucuuuuaggagagguaaugguugcugugaaaucaagcugcacgcauuguccuucuagucaugugauaauga

SEQ ID NO: 2246130 - RNA, 94 nt, Homo sapiens
uugcuuuuaagaaaaugcuuucuuggaccauuuggauuacagccuuuccacuaggcugcaaauauucauaaagguauucauuccuaaaagacaa

SEQ ID NO: 2246131 - RNA, 128 nt, Homo sapiens
aaccuccaugcuggauauaagcaaagaggagaggaaagaccuaugcaggaagaaaugaguucuucccuauguguuccuuccugcauagguauuuccccuccuuucuacucauauuuagcaugcagguu

SEQ ID NO: 2246132 - RNA, 69 nt, Homo sapiens
uuggaauauuauuauugggcaguaaaauuauuaguuacuauuuaugauugucuaguuaguaguaucuaa

SEQ ID NO: 2246133 - RNA, 78 nt, Homo sapiens
caggaucuccaaauggcaguuuauucuaaaucaacauucaauaaguguugggcauuuggaaaaaacagccaguuccug

SEQ ID NO: 2246134 - RNA, 104 nt, Homo sapiens
uacaugaauaggagagaaacagagaucaguuaaugaagugagcauggguuugguuuuccaguuacacuuaaacuuuucagaauuccaauuccuauuccuaugua

SEQ ID NO: 2246135 - RNA, 78 nt, Homo sapiens
cuaggacucuuuucagaacaauucaggaggagaaacuuucuuuccuuuagacugaauccugagagaauaauagucuag

SEQ ID NO: 2246136 - RNA, 116 nt, Homo sapiens
uucauauccuauccuccgcugggcuaacauuuuacaauccuuccacaggcuguuaucagcuaacaccuugcagggauuaugacagcuggcucaggggaggaacacguggaaaugga

SEQ ID NO: 2246137 - RNA, 102 nt, Homo sapiens
cauuagaagaauugcugcuugcuuaucuccuuuuaaggggccaucaguaugaaagguuaauauuuucaauacuguugauccuuaugugauaguaaucugaug

SEQ ID NO: 2246138 - RNA, 59 nt, Homo sapiens
uguccaggcagaaguuugcugcagaggcaugggccucauggagaacaucugcuagggca

SEQ ID NO: 2246139 - RNA, 84 nt, Homo sapiens
ucaaggaaaugaguaguugcuaaauauugaguuaauauguuauacauuccuucucagugauuacagaauacuuauaucaaauga

SEQ ID NO: 2246140 - RNA, 62 nt, Homo sapiens
ucucugauacucuccuuuuagagaguuggagcccaauuccuacccuauugaguauugagaga

SEQ ID NO: 2246141 - RNA, 69 nt, Homo sapiens
gauaaaugcuugagaugauggauacuccauuuacccugaugugauuauuaugcauuguaagcguguauc

SEQ ID NO: 2246142 - RNA, 67 nt, Homo sapiens
cgucaguuuacuguugccauggcaacacugggacguuacagucccuuuccauggcaaugaucugaug

SEQ ID NO: 2246143 - RNA, 85 nt, Homo sapiens
uauggaacauagugagagggugugaacacuggcugugcaaccucagaaagggucuaccuaguguugacuucucuucuuucacaua

SEQ ID NO: 2246144 - RNA, 64 nt, Homo sapiens
uucgguuugccaguauuuuauugaggauuuucauguugauguucaucagggauauuggccugaa

SEQ ID NO: 2246145 - RNA, 75 nt, Homo sapiens
aguucguacccuuaagcacuaguucagcuguucucaaacuuaaauacgcauaauaauagcuuaggggaacugauu

SEQ ID NO: 2246146 - RNA, 56 nt, Homo sapiens
gaggucauguggcaggcagccagugugccucaagggccccugccugcucugaucuc

SEQ ID NO: 2246147 - RNA, 92 nt, Homo sapiens
gccugacucuuggcaagugcuugaugaaugaucaauauuauuauuacuauuguuguuauuauuacuaagucuuccuaagaagagucaugggc

SEQ ID NO: 2246148 - RNA, 81 nt, Homo sapiens
gaaguacaaaugagagagugucaugaauggguucuggaaauaaaccuauacccaguguucaacauucacauucuguguuuc

SEQ ID NO: 2246149 - RNA, 59 nt, Homo sapiens
ccaugaaagcaaauacaaaauggcugacuauaugcagcuaguauucacuuuuuucaugg

SEQ ID NO: 2246150 - RNA, 78 nt, Homo sapiens
cuccucuggguucuugggugaaggucacacuugcauucauaggacagcauucaugacagucaccaggacccacaggag

SEQ ID NO: 2246151 - RNA, 69 nt, Homo sapiens
ggaaugucuucugagcugagaaaugcagcagcucuagaguucugauuaguucagcuuugaaccacuucc

SEQ ID NO: 2246152 - RNA, 63 nt, Homo sapiens
ccuugaggucaggacagcuucagcaaggcacaggcacagcgguggaauguucugacuucaggg

SEQ ID NO: 2246153 - RNA, 60 nt, Homo sapiens
agggagucacuuccccuugucaugagggaugcuuaugacuucagacugaaaugauucccu

SEQ ID NO: 2246154 - RNA, 68 nt, Homo sapiens
ggguacacguucacaacgugcagguuuguuacauauguauacauguuucauguuggugugcugcaccc

SEQ ID NO: 2246155 - RNA, 80 nt, Homo sapiens
acuaaacccccaaaaaaguuauuagguguuugacaguuucauuucuuugacugguaaacaacaggagaacuuggucuagu

SEQ ID NO: 2246156 - RNA, 69 nt, Homo sapiens
ccagguuucuuaugcaacuugaaauuuuccggauguucauaugcugcaaaauuuugcguuguauccugg

SEQ ID NO: 2246157 - RNA, 106 nt, Homo sapiens
aaaucuguuuuccuucccguuagucuaguucugcccauuggcauuaccuggaucaagucgaaugaccaaugggcagagcuagacugaugggaaggaaaacagauuu

SEQ ID NO: 2246158 - RNA, 68 nt, Homo sapiens
uccaggagauacacugcaccagccaagaagcacgaaacacaggaauggaaguggagugucuuccugga

SEQ ID NO: 2246159 - RNA, 69 nt, Homo sapiens
cuauugccaaagauuuaacuguuaacuauuugggaauccuguaguuaacaguuaauucuuuggcaauag

SEQ ID NO: 2246160 - RNA, 71 nt, Homo sapiens
cccagguggggucaguggcgggggagaggguugcagugaggcgaaaucaugccacugcacuccaaccuggg

SEQ ID NO: 2246161 - RNA, 83 nt, Homo sapiens
aaaagcuaggugaagaagucagagcugugaguuaagucaccuaagguuugacauagagccuugacuucauucaagaugcuuuu

SEQ ID NO: 2246162 - RNA, 57 nt, Homo sapiens
uugcuuaucauuguguaagugaauccccagagucaccuugcacaguugugugggugg

SEQ ID NO: 2246163 - RNA, 111 nt, Homo sapiens
ccuuccuguuauaucuuuuauguucuuccuucaauuuggaaggagagaaaauaucuucuugcauuuucuaggagggcaaauagguaaauaggugauuauaagacaacaagg

SEQ ID NO: 2246164 - RNA, 60 nt, Homo sapiens
guggaagguaaguuuugagcauuauauacuucugaaaaugucuuuauuuuaccuuccuac

SEQ ID NO: 2246165 - RNA, 58 nt, Homo sapiens
ugagauaucauuucacacccaguaggauggcuguaauuuuuuuugagauggagucuca

SEQ ID NO: 2246166 - RNA, 63 nt, Homo sapiens
acaaguguuucaguggguacaugcuuccguuucuuguggguaaauacccagaagcagcauugu

SEQ ID NO: 2246167 - RNA, 73 nt, Homo sapiens
agaagugaaauacuuaauuucuccaugcugguuacacugcaccaggaccagggccaauugguacuuuccuuuu

SEQ ID NO: 2246168 - RNA, 55 nt, Homo sapiens
gagccaauaagcauguagaagauauggagcaccuauuacuauguaguauuggcuc

SEQ ID NO: 2246169 - RNA, 88 nt, Homo sapiens
cucuggccugaaacugauggcugugauuuugauuugcaggcuggguuugaccaaagaagagucauugcagcagaacgugggccaggag

SEQ ID NO: 2246170 - RNA, 118 nt, Homo sapiens
cuccuuccagcuuucugcucugccauuacuagaaugugaacaucuugaaaguccagccugcacaguuucauccucagacuucacguuccauguagcagguuagagaaagaggaaggag

SEQ ID NO: 2246171 - RNA, 69 nt, Homo sapiens
auggucuaauagcauuuuagagcauaauaagaaugauagaguuacugucucugguuugcauuggauuau

SEQ ID NO: 2246172 - RNA, 72 nt, Homo sapiens
uuccuccacaguggugaggugcagcagcuuccuuggcaaaugacuucugcguacucuccccacauggaggag

SEQ ID NO: 2246173 - RNA, 55 nt, Homo sapiens
uugagauggugucaugcucugucacccaggcuggagugcaauggcaccgucucgg

SEQ ID NO: 2246174 - RNA, 106 nt, Homo sapiens
gcuucgucucagaggggcaccuggcuguaugaggugucaguuggccccuacugggagaugccucccaguuaggcuacucuggcaucagggacccacuugaggaggc

SEQ ID NO: 2246175 - RNA, 67 nt, Homo sapiens
ucugugguuacguucuuugugcugucuuugucuggacuugguaucagaguaacgcuggccucacaga

SEQ ID NO: 2246176 - RNA, 85 nt, Homo sapiens
gagaaucgcuugaacccaggaggagagguugcagugagucgagauugugccauugcacuccagccugggugacagagugagacuu

SEQ ID NO: 2246177 - RNA, 78 nt, Homo sapiens
gaggguacagauaacaguaucuaacgagugaugauugcuguugcugggucauagugggggauuuguuguguguuccuu

SEQ ID NO: 2246178 - RNA, 84 nt, Homo sapiens
uccuggauuaaagggaggugauccuaguuauugggguuggaguuuuaauagcuguuuuuaauuccugcuggaagugguccaggg

SEQ ID NO: 2246179 - RNA, 57 nt, Homo sapiens
gugaacaauguuuuauccugggaaaucaguguaccucccauagguauuuuuguucac

SEQ ID NO: 2246180 - RNA, 66 nt, Homo sapiens
agugagcggucucacaggcaugaugccagcuacaaggggcuggcgagcugaugugggaggaucacu

SEQ ID NO: 2246181 - RNA, 114 nt, Homo sapiens
ugaugagauuugaauauauggagugcgaggugcuuuugauucauacaaguaggcagugaauacagguaugaaucugagagaucuggaaugugaagauaggcuugggaaucauca

SEQ ID NO: 2246182 - RNA, 62 nt, Homo sapiens
aacccguuuccuggaguucaguaagcugcucuaacaaguuuaucaaacccaaggaggggguu

SEQ ID NO: 2246183 - RNA, 64 nt, Homo sapiens
guuugguucaguuuaacgaguaauaucugcuggauguuagauacugcggaggugcugaucagau

SEQ ID NO: 2246184 - RNA, 61 nt, Homo sapiens
aggagauaagagaaugaguugucuguuucuuauuuuucauagcugguuucuucuuacuccu

SEQ ID NO: 2246185 - RNA, 85 nt, Homo sapiens
agagauaaugagggcauggaccagggaagagauagcaggaacgcugucuccuaacugucucccuugguccugaaaucuauucucu

SEQ ID NO: 2246186 - RNA, 86 nt, Homo sapiens
aguaucacccccaucuccccaguuaugacaaccaaaaaaugccucuaauuuuugguugucacaacugggggaaugggggugauacu

SEQ ID NO: 2246187 - RNA, 89 nt, Homo sapiens
ggagaaucgcuugaaccugggaggaggagguugcagugaggugagaucgccccauugcacuccaccuuggguaacaagaacaaaacucc

SEQ ID NO: 2246188 - RNA, 78 nt, Homo sapiens
uggcuagaauaaagcaggcagaagaaggaggaaugagcagacuugcugaguucuggccuccauuuuucuccugugcua

SEQ ID NO: 2246189 - RNA, 71 nt, Homo sapiens
agaggcauugagcucugucgauugcuuaggccgcauauuucaggacugacauguauuagcucagugcuucu

SEQ ID NO: 2246190 - RNA, 102 nt, Homo sapiens
ugaggcaggagaaucgcuugaacccaggaggcagagguugcagugagccaagauccgcgucauugcaugccagccugggcaacagagugagacuccaucuca

SEQ ID NO: 2246191 - RNA, 63 nt, Homo sapiens
gggacugugacaggagauuaugugauguucaugagaugaucauacugucucuguccagguccc

SEQ ID NO: 2246192 - RNA, 73 nt, Homo sapiens
gccugccugugcuagugcagggaaaucuuuggaacucuuucaaauguucccuguacuggccggacaaccaggc

SEQ ID NO: 2246193 - RNA, 56 nt, Homo sapiens
uugagauggagcuucacucuuguugcccaagcuggagugcaauggcgccaucucgg

SEQ ID NO: 2246194 - RNA, 81 nt, Homo sapiens
gucaccucuuuauaauucuggcauaggcuguugggccugagcuggccucauggucuuuucccuggauuauaggaggguggc

SEQ ID NO: 2246195 - RNA, 123 nt, Homo sapiens
uuagugccagaauggucugggugauacuagggggauguagaagagcuaauauuauucuucacaagguuauugguacuacacuucuaaucuuccauuuuuacaacagaugcuggauguuacuga

SEQ ID NO: 2246196 - RNA, 69 nt, Homo sapiens
ggcaccuagaagaauuuuaguaucuuacuccccugcauuucagugagaugcuuguaaauucauuuugcc

SEQ ID NO: 2246197 - RNA, 69 nt, Homo sapiens
ugaguacugauuuaagauacacacaugugaaucauucucucuguggcugugucucaagucagagcauca

SEQ ID NO: 2246198 - RNA, 89 nt, Homo sapiens
ggagaaucgcuugaacccgcgagguggagguugcagugagccaagauugugccauugcacuccagcuugggcaacaagagugaaacucc

SEQ ID NO: 2246199 - RNA, 103 nt, Homo sapiens
ggcugagccaggaagaacgcuccagcccaggacuucgaggcugcaaugagcuauaauugcaucauugcacuccagccugggcaacagagacccugucucaacc

SEQ ID NO: 2246200 - RNA, 55 nt, Homo sapiens
ccuagaauguauaaaaccaagcuguagccugacaccuuggucacauguucucagg

SEQ ID NO: 2246201 - RNA, 109 nt, Homo sapiens
ggacauuuauagcagaaauaugaguauucagugcgugcauagccuggauuauaucgugagaauaaucugguguauauaugcaccauucagucuuaaugcacaagugucc

SEQ ID NO: 2246202 - RNA, 58 nt, Homo sapiens
acucaagccuggggagguggagguucaguaagccaagaucaugccacugcacuugagu

SEQ ID NO: 2246203 - RNA, 55 nt, Homo sapiens
guggaucaaaccccagcucuacuaaaaauagaauuagcuggguguguuggugcau

SEQ ID NO: 2246204 - RNA, 89 nt, Homo sapiens
gagguaacacuguagcugagggcaugcguucaggaguuaaucugcccaauucaaauucuggcuugacagccuucuagcugcaugaccuc

SEQ ID NO: 2246205 - RNA, 57 nt, Homo sapiens
cucaccuugugauccacccaccucagccucccaaugugcugggauuacaggcgugag

SEQ ID NO: 2246206 - RNA, 57 nt, Homo sapiens
uuuugaggaacuuuauucuuaucuauauccaggauacacugugagguauccucaaaa

SEQ ID NO: 2246207 - RNA, 98 nt, Homo sapiens
uaucuggcaagauuccugacaauuuagcaauugauucucauaagccgguucuaucuggcucuaagaaaucauugcuuauagguacucuagucaaggua

SEQ ID NO: 2246208 - RNA, 64 nt, Homo sapiens
ucagugauaggugguuguuggcaaaauuaagucugaaauacugccaaaguuuaccuaacacugg

SEQ ID NO: 2246209 - RNA, 73 nt, Homo sapiens
uauugcauauuauucuaguggcuuuuaucucuuacgaaacauacugugguaaaaugacuagugauuugcaaua

SEQ ID NO: 2246210 - RNA, 91 nt, Homo sapiens
caguaugcugcucaauuuuuauuccacuuccacuaguuucucuucaaagagggcucugucuggaagggaacccuggguuggugcauuucug

SEQ ID NO: 2246211 - RNA, 55 nt, Homo sapiens
gagcuguauuuucuuuacaugcaguggucagcuacugccaagaugacuauagcuc

SEQ ID NO: 2246212 - RNA, 103 nt, Homo sapiens
ccauauuuuuagguauuugguauagcaguaccucacuucugaguaucaauuuucugucuuagaucauucaggcugcuauagcaaaguaccauagauuggaugg

SEQ ID NO: 2246213 - RNA, 90 nt, Homo sapiens
gaccggucauuuuuuaagcugguaguguuuauaaggguauuauucauauaauaauuuacuaagcucuaccuuuuuuuguguggccguguc

SEQ ID NO: 2246214 - RNA, 62 nt, Homo sapiens
ucauuccucuuaaagguaucauugaagcuaugggaaugagugagaucacuaagagguaaugg

SEQ ID NO: 2246215 - RNA, 56 nt, Homo sapiens
gugaacuaaggauucaaacuucagauuucaaaguccaaagugaaugcuuuguucac

SEQ ID NO: 2246216 - RNA, 71 nt, Homo sapiens
gaucaguaggugauccauuuguauuuuauuuuauuuagagauggggucacacucuaucacccagacugauc

SEQ ID NO: 2246217 - RNA, 64 nt, Homo sapiens
auugugaauagugcugcaauaaacauacaugugcaugugucuuuaaagcagcaugauuuauagu

SEQ ID NO: 2246218 - RNA, 86 nt, Homo sapiens
gcuaugguuauggauauggcuauggcuguggcuauggcuauggauauggcucuggcuguggcuauggcuauggauauggcucuggc

SEQ ID NO: 2246219 - RNA, 90 nt, Homo sapiens
ucagcggauaggugcuauuuaaggccaugcuauuagaugaggccacucagagaucuagaaagcaugaccuucagauaacacagucucuga

SEQ ID NO: 2246220 - RNA, 73 nt, Homo sapiens
cugauucaauagcaagaugauugauccauuucuuucgugagaaauggaucaauuucuuuugugagaaauccag

SEQ ID NO: 2246221 - RNA, 79 nt, Homo sapiens
ccuuuuuuaaaguuuguauuaaauauaacccugagauaauucuucauaaaguuguuuuaaugggaacaucacuggaagg

SEQ ID NO: 2246222 - RNA, 103 nt, Homo sapiens
aaggccuuuucugcaucuauugagauaaucaugugguuuuugucauugguucuguuuaugugauggauuacauuuauugauucguguauguugaaccagccuu

SEQ ID NO: 2246223 - RNA, 62 nt, Homo sapiens
ggaugacucuaggggccucccaagggcuuuccacauccccuuuggucccucucaagucauuc

SEQ ID NO: 2246224 - RNA, 70 nt, Homo sapiens
ggugcaagcuguugguggaucuaccauucuggggucuggaggaugguggcccucuucucacagcugcacu

SEQ ID NO: 2246225 - RNA, 58 nt, Homo sapiens
ucauugcacuucuuuaguugcagguaauuggaccugacuaacuuaaggggguuaaugg

SEQ ID NO: 2246226 - RNA, 97 nt, Homo sapiens
cacacacacauauauacauauauaugcacuauacacacguauauauauauauauauauacguguguguauguaugugugugugugugugugugugug

SEQ ID NO: 2246227 - RNA, 73 nt, Homo sapiens
cggcuuuuauuacguugagauacauuccuucuauacccaguuucuugaggguuuuuaucauguagggaaguug

SEQ ID NO: 2246228 - RNA, 87 nt, Homo sapiens
uuguuguuguuauaucagugucuuacuguuuuuccacuuuuuuguguguagucagagaaacaaaguacauugauguuuguuuaaagg

SEQ ID NO: 2246229 - RNA, 57 nt, Homo sapiens
gcugacucaguuucucagguaguaaucuacuauagacugcugccaaacuggggcagu

SEQ ID NO: 2246230 - RNA, 90 nt, Homo sapiens
ggagaagcagcauucuauaguccuaggauugggucucagccuuuucgugagccuguguccccagccugugaccuucaugggugcuucucc

SEQ ID NO: 2246231 - RNA, 81 nt, Homo sapiens
cuguucccugcucacugccagcuggugucuauuuaggaaacugaaacuuaugcuuguugcagccugagccuaacagaacag

SEQ ID NO: 2246232 - RNA, 55 nt, Homo sapiens
uuaggucaucgcuguccuucagaacuguccucugcagaggggccgcgacaucuga

SEQ ID NO: 2246233 - RNA, 77 nt, Homo sapiens
gugcaugaaugugaguguugagugucuauacauuuucucucugaauuuuggaauaguauaaauaccacaaaauguac

SEQ ID NO: 2246234 - RNA, 76 nt, Homo sapiens
uaugcuaucauuggcaauguacauaucuugcccuaccagauugggcagccuuauguucauuagcuaucauaucaua

SEQ ID NO: 2246235 - RNA, 76 nt, Homo sapiens
ggguggagguggagguauaagcccagaagaguauucuugaauuuuuuuggcuagaaauauaccuccaaauacaccu

SEQ ID NO: 2246236 - RNA, 118 nt, Homo sapiens
cugaguuugaaccucagccacccaccugcaggcugagugacccugggcaaccuuuucccccucucucugcucaguuuccucagcugcaaaauggguaaaauccugguaccauucucag

SEQ ID NO: 2246237 - RNA, 67 nt, Homo sapiens
aagcagggaaucauaugcucccuuucugagaucccaauuuuuuaguuuguauuugacuuucuuguuu

SEQ ID NO: 2246238 - RNA, 130 nt, Homo sapiens
cugcuuuuguuacuccugugaauaaguuagguuauauagcaaaagugacauugcagaugaccuuaaaauagggagguuaucccgcauuauuugguugagcccaauauaaucacaugagccuuaaaagcag

SEQ ID NO: 2246239 - RNA, 77 nt, Homo sapiens
agagaaaucaugaaguaggcauaaguuaagcuuagugaauuucagcuuacucauugugcuugguuauuugauucucu

SEQ ID NO: 2246240 - RNA, 61 nt, Homo sapiens
agagguagaagauaggcuacagaggcuagcuaaaggccagcuguggaggacucugacuucu

SEQ ID NO: 2246241 - RNA, 80 nt, Homo sapiens
gaggaacaggugccacugagguaggugaucagugcuuaaauccauaagcaucugcuucugaguucauugaucuguuucuu

SEQ ID NO: 2246242 - RNA, 95 nt, Homo sapiens
uuagaauuuauauuuagcuguuguuuauaauaugagagacuuaaaaccuagaauauuuucuucauauugguuaaaauagugggauagaauuuuaa

SEQ ID NO: 2246243 - RNA, 72 nt, Homo sapiens
ucuaauugagguaguacuuauuauuggaagccuaugcaaagguauuggaauggggauuauuuugcaauugga

SEQ ID NO: 2246244 - RNA, 78 nt, Homo sapiens
uggaggcugcagugguaguauugcuugaguccaagaauuugagguuccagugagcaaugauugagccacuguacucca

SEQ ID NO: 2246245 - RNA, 61 nt, Homo sapiens
agucaaaaaagaagcuauuauuaaauggaauaacauaguaauaaagcagcuuuuugggacu

SEQ ID NO: 2246246 - RNA, 64 nt, Homo sapiens
gucaucucuagcaaagaguguuuucagauauuuuuccuuaugugauuauuuuugcagaaaugac

SEQ ID NO: 2246247 - RNA, 88 nt, Homo sapiens
uuuuagauuccuaguuagcauaauuuguagaaaaucaaagcuagacaguagugaugucucucaaauuuguuugacaagaggucuaaaa

SEQ ID NO: 2246248 - RNA, 55 nt, Homo sapiens
gagggaaaaaaggaugggugugucugaacuaaacauguauagacuuuuuuuccuu

SEQ ID NO: 2246249 - RNA, 61 nt, Homo sapiens
ugcuuguaguaaggaagaaaacugucauaacacaaaggugauggcuucuuaauugcaggca

SEQ ID NO: 2246250 - RNA, 82 nt, Homo sapiens
uguggcagccuccaguacagagagguuccucgagguggucaaccaggcaggccucccugugcugugaggggacgcggccaca

SEQ ID NO: 2246251 - RNA, 112 nt, Homo sapiens
cugcuuaccccuaauuucuuacuuuucuacagugaacgauuucuaaauuacuuauuuucuaacuuuuaggagucuuagcugugaagggaagaaaaaaaacaugggauggcag

SEQ ID NO: 2246252 - RNA, 69 nt, Homo sapiens
gcuugaacccaggaggagguugcagugagcagagaucacgccauugcacuccagccugggugacagagc

SEQ ID NO: 2246253 - RNA, 64 nt, Homo sapiens
ugggcaguauggucauuuucacaauauugcuucuuccaaucugugagaaugguauauauuucca

SEQ ID NO: 2246254 - RNA, 57 nt, Homo sapiens
augcaaagugcuccagugaucuaagcaaaguaguuuguuuuggaguggacuuugcau

SEQ ID NO: 2246255 - RNA, 55 nt, Homo sapiens
auaaggcuaguguaggagccagcaaauuauguuuccuccauaauuagagucuuau

SEQ ID NO: 2246256 - RNA, 60 nt, Homo sapiens
uguaaagaaagcuguuguuguauucugcucaauggaauguaugauacaguuuauuuuaca

SEQ ID NO: 2246257 - RNA, 57 nt, Homo sapiens
uauaugguuuuaagguuaaggacuuugguaggcagaauagucccuuaaaacuaugua

SEQ ID NO: 2246258 - RNA, 77 nt, Homo sapiens
ucgcuugaacccaggaggcagagguugcagugagccaagaucgcgccauugcacucuagccucggcaacaagagcga

SEQ ID NO: 2246259 - RNA, 67 nt, Homo sapiens
aagguccuuaagguccaucgggagauuagggucaacccucauaccugagacaacuuugaggaaucuu

SEQ ID NO: 2246260 - RNA, 124 nt, Homo sapiens
gacauccaugccguuuucccuuuucagggcuugauuuuacagaggagcaggcugaggcugggccaucccagugcacugcccgcuuccugucaaggugucuucugcccuggaggccaccuguguc

SEQ ID NO: 2246261 - RNA, 57 nt, Homo sapiens
uagucaaaaaucacuagcuaugaagaguggcugucaaaugcagugauauuugaacua

SEQ ID NO: 2246262 - RNA, 64 nt, Homo sapiens
uugcacuguaauuuauuuauguaucugucucucccacuagacuccaugaauagguugagggcag

SEQ ID NO: 2246263 - RNA, 67 nt, Homo sapiens
ucuauggguggugagcaguaaagccauuagguguuggugacccuuggcacugcucacccuccuugga

SEQ ID NO: 2246264 - RNA, 56 nt, Homo sapiens
cacaguucccauaacccguauucuggagguuagacagauaugggguuugaacugug

SEQ ID NO: 2246265 - RNA, 57 nt, Homo sapiens
uuggcacuugauaauauucugggcuccuuuguuucccaguuuguuaaacagggucag

SEQ ID NO: 2246266 - RNA, 126 nt, Homo sapiens
ggaaauugggaagggaccaagauggccaggguggguaggggaaggggaguauuugaaaucagaggccuggggccaguuggcaagaaccuucuuccaagcuauaugccaugguucaagcccuguucu

SEQ ID NO: 2246267 - RNA, 71 nt, Homo sapiens
auauuugggaaauagguuauaggccacaaaaauauuaucugcuugacaacuuaugaccauuuccauaguau

SEQ ID NO: 2246268 - RNA, 96 nt, Homo sapiens
ggcacgacagcauaacaguaugagacugugagugagaaauaaccacaaagguucauuucucacucacaguccauguccacugugugcucuggagcc

SEQ ID NO: 2246269 - RNA, 68 nt, Homo sapiens
gaaugacccagaaagcucugucuggccuuuggccaaaauuggcauggcagguuggucuaggucuauuc

SEQ ID NO: 2246270 - RNA, 61 nt, Homo sapiens
uucacacauaaggaaucuucagggacuccccaaaauaaaugaggauauuuuuauguuugga

SEQ ID NO: 2246271 - RNA, 60 nt, Homo sapiens
auaguaucacauggucuuaauuacagcgguuuuauuauaauuuuggacaugugguauugu

SEQ ID NO: 2246272 - RNA, 110 nt, Homo sapiens
cuaguuguguuugagugccauuagaauguaaauuccaagggcaggacauuucugccuguuuuguuucugcuuuuguuuguuauauucccagcaccuaaaaccacaccuag

SEQ ID NO: 2246273 - RNA, 63 nt, Homo sapiens
aguuauuucuuuggaaccggguuaugaguggcccucacaugagucuguuccaaagaaauaacu

SEQ ID NO: 2246274 - RNA, 91 nt, Homo sapiens
gcuauuccagacuucccucaucagaaucccuuagggauggggcauuagaaacuuauauuuuaacaagcacccuaagugauuuuuauguagc

SEQ ID NO: 2246275 - RNA, 86 nt, Homo sapiens
acugggucauaaaugaauauuugcuacucacucuucaguuuccuugucuucugcugaagugccuggcaaguguucgauaauucagu

SEQ ID NO: 2246276 - RNA, 60 nt, Homo sapiens
augguacucuauggaaagguuugccaaugcuacagaagagaaccccuauagagaaaccau

SEQ ID NO: 2246277 - RNA, 113 nt, Homo sapiens
guuuuuauagaaucuugucuuuugcacaauaaaaggcaauucuccauuucaaugcagauauugaguaaaugaaaauugccuuuuuaaauuugagaggacagaagaauaaagau

SEQ ID NO: 2246278 - RNA, 70 nt, Homo sapiens
ugcuuauuuuuauacuaguaccaugcuguuauggugacuauggccuuacagucuaguuugaagucaggua

SEQ ID NO: 2246279 - RNA, 58 nt, Homo sapiens
gugaguagugcugcaauaaacauaugugugcaugugucuuuauagcagcaugauuuau

SEQ ID NO: 2246280 - RNA, 98 nt, Homo sapiens
ggguguguagccauuuuuccuuguguucaugugauuaaggugaacacauucuucaaacaccucaacaccguagaaacacaagggaauuccugcuaccc

SEQ ID NO: 2246281 - RNA, 86 nt, Homo sapiens
guggaggaagaguacaauagugacaaaucagcaugcaaacauuuuucggcugauuuugcacucuuguccucucaguguuccucuau

SEQ ID NO: 2246282 - RNA, 87 nt, Homo sapiens
caguaucacuccauuuaguccuuuuagaagaaauaguacuucauaggcuuuacugacuuuuuaggggacugaaugugguaguaauug

SEQ ID NO: 2246283 - RNA, 55 nt, Homo sapiens
uuggcuuggagaguugaaauguuaauuugaugugcacaucuauucuuaaagccaa

SEQ ID NO: 2246284 - RNA, 78 nt, Homo sapiens
ugcaccuuuucaauuggcagugcucuugccacaugaaucgcucaucugcccaggauguuuugccaaacauaggugaca

SEQ ID NO: 2246285 - RNA, 74 nt, Homo sapiens
gcucuucugagauaaauaggucacaguucucuauugggagaacauuugucgaucaauuuguauaacaguagggc

SEQ ID NO: 2246286 - RNA, 126 nt, Homo sapiens
uuguugggaacuggaacacaguugacucuuguuauguuuuagcaaagagacugguggcauuuuaucccugcccuagagauuuguggaacuuugaacuuaagagaggugauuuaggguaucuagcag

SEQ ID NO: 2246287 - RNA, 58 nt, Homo sapiens
guaaauagugcugcaauaaacauacaugugcaugugucuuuauagcagcaugauuuau

SEQ ID NO: 2246288 - RNA, 63 nt, Homo sapiens
gguuuuaaaacuguuuaguacauuaaguuacuaaugcuuaaaaaguuagaugguuuuaaaacu

SEQ ID NO: 2246289 - RNA, 66 nt, Homo sapiens
auagguaguugaggagauuucaaagcaaaaugugaugguguggccugaauacuccuaacugcuuau

SEQ ID NO: 2246290 - RNA, 112 nt, Homo sapiens
gaggcucacaaaaguuaggcaguugcccagguuuauugccgagccaagauuuaaacucaugcuaaucccaaagcuuguguauuaaaccuugcagcugugaccuugaggcuuc

SEQ ID NO: 2246291 - RNA, 111 nt, Homo sapiens
guuuagacuaucauuucuugcauaucaacccaagcauacugugagaguuuuaaacaagaaucuuaauaaagcuauuauaguuauguuuuaaagaaguggauuuguuuaaau

SEQ ID NO: 2246292 - RNA, 61 nt, Homo sapiens
uuauuagcagcaugagaauggacuaauauaguaaauugguagagugaggugcugcuguuaa

SEQ ID NO: 2246293 - RNA, 58 nt, Homo sapiens
uaguguccacagauggauuagugaacgagauguggcauauccguacaguggaauauua

SEQ ID NO: 2246294 - RNA, 59 nt, Homo sapiens
uuaguucauugugacuggacucagagcuagagguacaguucaguaagagaugaggcugg

SEQ ID NO: 2246295 - RNA, 65 nt, Homo sapiens
gugaaguagcaggauuguuacaauaguaaucagauuacuuaaauuuuaauccuuggugcuaucac

SEQ ID NO: 2246296 - RNA, 91 nt, Homo sapiens
uuugagucauuguggaaagaguaggggucccauuugccauggcauaugcuugcgacauguggguccccuacucuuuccacagugacucaaa

SEQ ID NO: 2246297 - RNA, 99 nt, Homo sapiens
gaggcagaagaauugcuugaagcugggaggcggagauugcagugagcugagaucaugucacugcacuccugccugggugacagagcaagacucugucuc

SEQ ID NO: 2246298 - RNA, 125 nt, Homo sapiens
cccaccuuggccucccaaaguguugcguuuacaggugugugccaaggugcccacucaaaaacggguucuuggcugggcacuguggcucaagccuguaaucccagcaccuugggggucaagguggg

SEQ ID NO: 2246299 - RNA, 84 nt, Homo sapiens
uucaaaaugguggcuccauguucccuucucuuugccagccauguguacaguaaggaguagacaacauggcgccagccaagugaa

SEQ ID NO: 2246300 - RNA, 61 nt, Homo sapiens
ugugaugcuguggguauaacgauaacucccccaaacguaaucauaauaccacagugacaca

SEQ ID NO: 2246301 - RNA, 80 nt, Homo sapiens
aaaugguuagauuuuguuaucuguuuagcguuaauuucuaauuuuaaugcaucaugguuggcaaacaugacugauuauuu

SEQ ID NO: 2246302 - RNA, 57 nt, Homo sapiens
uugaaagaacuauguuguauaccuggucaaauaagguacauaaccuggugcuuucaa

SEQ ID NO: 2246303 - RNA, 57 nt, Homo sapiens
gaaagagaggggcugagaugcagaccagucuguucucucaguggcuuccucacuuuu

SEQ ID NO: 2246304 - RNA, 67 nt, Homo sapiens
gggugaguggggucugucugagauggcuucuagguggaagcugccuugugaaggcauucauucauuc

SEQ ID NO: 2246305 - RNA, 128 nt, Homo sapiens
gguaucgccagcugcacccauuuucugcacucgggaauucaagggguguuuucagcugacugaagcaucauuugauguucccgagaaacagauuccacaaccaacuccaaugcauuuuggcccugacc

SEQ ID NO: 2246306 - RNA, 62 nt, Homo sapiens
aguguuaguaaaaaccuagucaaggaggccauuauuuuugacaggucuaauuuacugacacu

SEQ ID NO: 2246307 - RNA, 56 nt, Homo sapiens
gcuagguuggggaaguucugcuggauaauauccugcaaaguguuuuccaacuuggu

SEQ ID NO: 2246308 - RNA, 59 nt, Homo sapiens
auccucaguggcuuaaguauaguuauuaguuaaggcugugguuaaguuuagcugaggau

SEQ ID NO: 2246309 - RNA, 68 nt, Homo sapiens
aagucuuugcuauugugaaucaugccacaguaaacauacgugugcaugucuuuuuaguaggaggauuu

SEQ ID NO: 2246310 - RNA, 85 nt, Homo sapiens
gacacuugagauuacguucggcccacuuggauaaucccacaucaucuucccaucucaagaucaugaacuuaaucugcaaaguguc

SEQ ID NO: 2246311 - RNA, 55 nt, Homo sapiens
aggagagugggggaaacagaugagugguuuagucacauguuugcuacauuuuucu

SEQ ID NO: 2246312 - RNA, 61 nt, Homo sapiens
aaauucagggacucauaggcagaagggacuguggccuuaucugagaugagacuuugaauuu

SEQ ID NO: 2246313 - RNA, 89 nt, Homo sapiens
uaagccuauugugaagaaaccagaaaaguuuuuuaaaagcaaauaaauaacuagauagcuuuauuuuguuuuguuuuacaauggacuua

SEQ ID NO: 2246314 - RNA, 79 nt, Homo sapiens
accuacgguauagauuguauccuaggagugaaacccaagacauguaaccuaggugugcaguaggcuauaccaucuaggu

SEQ ID NO: 2246315 - RNA, 76 nt, Homo sapiens
cguugggaguuugcauagacaauauuaaucuucacaaaccuucuguaagguagauguugucaugcccauuuuaaug

SEQ ID NO: 2246316 - RNA, 73 nt, Homo sapiens
agcagauacuuuugaggagccuucauugcaaggaccugagacucccagugaacacagcuucuuugguucugcu

SEQ ID NO: 2246317 - RNA, 67 nt, Homo sapiens
guuuuuagccaggcuuugguacacgguauuuggggagaucauauacauuaaugcucugguuagaggc

SEQ ID NO: 2246318 - RNA, 60 nt, Homo sapiens
agggagaaacaaaggccuccagaauugcaaguaaccgguaggagguguugauuuuucuuu

SEQ ID NO: 2246319 - RNA, 117 nt, Homo sapiens
gagaauauugaauguuuccaacacaagaaaugauaaauguuugagaugauggauaucuaauuacguugaucugauccccucacauuauuauaugugucaaagcaucacaauguacuc

SEQ ID NO: 2246320 - RNA, 60 nt, Homo sapiens
ggacuagaucucccggcuucuaguucuaaacucuuuuuacugcaccaggucaucuggucc

SEQ ID NO: 2246321 - RNA, 87 nt, Homo sapiens
auauaauaugaguauuuuacaucguguaauugacuacuugaucgauucauaaauuauauuguggugugaaugugucugauaauauau

SEQ ID NO: 2246322 - RNA, 64 nt, Homo sapiens
acugugaauagugcugcaguaaacauaugugugcaugugucuuuauagcagcaugauuuauagu

SEQ ID NO: 2246323 - RNA, 65 nt, Homo sapiens
cuuagcauccauaggagauugguuucaggauccccuauagauaccaaaaucuguggaugcucaag

SEQ ID NO: 2246324 - RNA, 78 nt, Homo sapiens
ucuguuugaaucacaguuauuagagcagccacaggcagggccacgagcggaggcugcucaacugugaugacagccgga

SEQ ID NO: 2246325 - RNA, 63 nt, Homo sapiens
aggaguaaugguucaguaguuguuauuucaguguuuguggcagcuucauugaacauaacuccu

SEQ ID NO: 2246326 - RNA, 57 nt, Homo sapiens
uaugucuggaucgucaggaguucccugcaggcggugaugcuuggcgaugccaacaua

SEQ ID NO: 2246327 - RNA, 64 nt, Homo sapiens
uagugagcuauguccugguuuggggccguccguuguuaggugcuccauuagggcuggcuuauug

SEQ ID NO: 2246328 - RNA, 74 nt, Homo sapiens
auucacacugaguaaauaaggcuaggaaaagaaaugcccuuccuguucauagucuaauuuuuuccacugugaau

SEQ ID NO: 2246329 - RNA, 76 nt, Homo sapiens
ucuuuuacuguuggacuuacuuggcagauugguuuuugaauagaagcaaucuugggaggucugagacaggauggga

SEQ ID NO: 2246330 - RNA, 94 nt, Homo sapiens
ccccacagccccaguggaggaaccuucuggugaacugaggagggagggacaagcccggccucaguucauggaggugucugcucugccugugggg

SEQ ID NO: 2246331 - RNA, 58 nt, Homo sapiens
ggucauguccagggacagaaaagacuggaaaauuaaguauuugccuaggcacauggcc

SEQ ID NO: 2246332 - RNA, 106 nt, Homo sapiens
aagccggagugcucguugucaacauauuaauuauguucucuguuuccacaggcuuuucaggaggauuuaaucaguuggcauuuaugagccuauuuugaaaaugcuu

SEQ ID NO: 2246333 - RNA, 100 nt, Homo sapiens
uauuugaaaacaugaucucccuaugcuuucugggcccugggucagcaguucagcuauccaacggcaagcagaagcauuaccuggaggguuuguucaaaug

SEQ ID NO: 2246334 - RNA, 57 nt, Homo sapiens
aaagcacacuguguacugguugcagaaucaguuggggaacaccagugcaugugcuuu

SEQ ID NO: 2246335 - RNA, 96 nt, Homo sapiens
guucagaaucugaaucggcucauaucucucuuauacgucaacuuccacuuuucugcaaguugguguaugagacagaagccuacucagaaucugaau

SEQ ID NO: 2246336 - RNA, 66 nt, Homo sapiens
gggugcguucugagaaguguguuguuaggcaguuucguccuuaugugaacaucauagaaugcacuu

SEQ ID NO: 2246337 - RNA, 71 nt, Homo sapiens
cuacucggagggagugaauuuucauuauacaacuuuuagcuaauauagucaaaucucauuacccccaguag

SEQ ID NO: 2246338 - RNA, 59 nt, Homo sapiens
uuuucccuagagaagugauuuuugaauugagauuuucagauuguauuuucuaggcaaaa

SEQ ID NO: 2246339 - RNA, 58 nt, Homo sapiens
uuugcccucaggaccuacagcccagccugugauguggcccagguucucugaggguaga

SEQ ID NO: 2246340 - RNA, 77 nt, Homo sapiens
uauguaaccuuuugagacugaacauuuguguacacguuuuggugugaacauacauuuucauuucucuggguuauaug

SEQ ID NO: 2246341 - RNA, 92 nt, Homo sapiens
auuugggucuuuauuauucagguaacuacuucugcuucagaguauuuacaauaccuuagcuggauuaguuaagccaugauggagaucugaau

SEQ ID NO: 2246342 - RNA, 59 nt, Homo sapiens
cccucaccaagggucccaaggaauaccaaacggucauuccuuaggcccuuugguuaggg

SEQ ID NO: 2246343 - RNA, 100 nt, Homo sapiens
guagauguauguggaguuaagucguggaugauucuucgguuuaaauuauuuucuuguuucugugggaucccaugacuuuccagacaucacucaccucuau

SEQ ID NO: 2246344 - RNA, 89 nt, Homo sapiens
cccacggcucccuuuaguggaaggagcacuggccuuggagucagacuaccuggguucaaauccaggcucugccacuaacuagcuguggg

SEQ ID NO: 2246345 - RNA, 66 nt, Homo sapiens
cauuuugccuguagacacuuacccucagagggguauuuugaggauaaaugagauacaggcaaagug

SEQ ID NO: 2246346 - RNA, 66 nt, Homo sapiens
uuuccucuguaguccugcaagaggagaagugacuaaauaaacucuuuuuuauugcuauauaggaaa

SEQ ID NO: 2246347 - RNA, 81 nt, Homo sapiens
uaauggcuggugaagguaggagucacacuuaguuaggccucuggcugcaaaguccucauucuuacccaguaucuuccauug

SEQ ID NO: 2246348 - RNA, 57 nt, Homo sapiens
gugugagugcacauagcucuagaaugccucacaugaccuugagaugugaacucacac

SEQ ID NO: 2246349 - RNA, 84 nt, Homo sapiens
gccaucugcgucugugcagugcuggagcccccgugugugccaggcaccacagggucgcugccagcacuccgcacccugcuuggc

SEQ ID NO: 2246350 - RNA, 83 nt, Homo sapiens
uagagaagaaaagguacaagcucuauagucagacacaucaugguucuauauggcucuguaauuuuagaugcauuaccucucua

SEQ ID NO: 2246351 - RNA, 76 nt, Homo sapiens
gggcuuuuaacagucuccucaagguguuguggcugugggagaagaauuaacaugaauggagaguguaaagaagccu

SEQ ID NO: 2246352 - RNA, 67 nt, Homo sapiens
gaaggguuuuuguaacguauacuguuauggugccuaauucuuggcagugguguuagagaaaucuuuu

SEQ ID NO: 2246353 - RNA, 82 nt, Homo sapiens
uagccuuugguuuaagggaauguuguagcugguuugaucuauccagaccacuguaacuuucucuacauaagcgauaagguug

SEQ ID NO: 2246354 - RNA, 61 nt, Homo sapiens
gguguaaggaaaugguucaguuucaauuuucugcauauggcuagccaguuuucccagcacc

SEQ ID NO: 2246355 - RNA, 69 nt, Homo sapiens
ucuuaguuuccuuauuuacaaaaggguuauauuaaugucuacccuuuagguuggaugaggauuuuaaga

SEQ ID NO: 2246356 - RNA, 75 nt, Homo sapiens
cuccucaggugccaagaucugaauaauuaagaggagagaaaaccugugacuccucucaucugccauuugcaggag

SEQ ID NO: 2246357 - RNA, 59 nt, Homo sapiens
cuucuugcuguguccucacauggccuuucuguggaguguguguugugcauugcagggag

SEQ ID NO: 2246358 - RNA, 55 nt, Homo sapiens
cuucuggaagcuccaaggaagaaucuguuucuuugcgcuuugcagcuuccagagg

SEQ ID NO: 2246359 - RNA, 61 nt, Homo sapiens
ucacggaagaagcguaugauguuacucccaauaucgcagggaguguacacuucuucuguga

SEQ ID NO: 2246360 - RNA, 75 nt, Homo sapiens
uucagccauaaacagaaugaguuccagucauuugcaccaacaugaauggaacuggagaucauuauguuagcugaa

SEQ ID NO: 2246361 - RNA, 70 nt, Homo sapiens
gccucagucaugugccuucaucuggagcugaagguggaguuagcgucaccugaaacacauggacuggggu

SEQ ID NO: 2246362 - RNA, 57 nt, Homo sapiens
uacuguaggacuacugugaaaucucuacuucuuggggucacugagugguccacagua

SEQ ID NO: 2246363 - RNA, 84 nt, Homo sapiens
gaugaacugauaaaagcuggcuuucauugagugcucacugugugccaggcacugcucgaagccaucuacauauaugaguucauu

SEQ ID NO: 2246364 - RNA, 83 nt, Homo sapiens
ccuauuacuaaacuugacaucugucaguuccucaaucaaaaagauacuauugagagcucaucacuguuaagugauauaauggg

SEQ ID NO: 2246365 - RNA, 56 nt, Homo sapiens
cugaugguuuuacacaagggcaguuccccugcacaugcucucgugccugccaccag

SEQ ID NO: 2246366 - RNA, 59 nt, Homo sapiens
uuuaaaugaaguuuggaguuucauaacaaaauucugaaaauguccagauuucaauugaa

SEQ ID NO: 2246367 - RNA, 84 nt, Homo sapiens
agucaagcauuaucguaguguuggaaaacaaguguagaaaaaaguagauucuguccuugucccaaacuugauaaaaaauguacu

SEQ ID NO: 2246368 - RNA, 85 nt, Homo sapiens
uauuaaguuggugcaaaaguaaucacgguuuuugccauuacuuucaauggcaagaaaaugcaauuacuguugcaccaaucuaaua

SEQ ID NO: 2246369 - RNA, 62 nt, Homo sapiens
gccugacuucuacaugguucauugugucaaccugagaccugauguccacuuagggucuaggu

SEQ ID NO: 2246370 - RNA, 71 nt, Homo sapiens
uuugggacauagaaauacuguugcagguaaugaugccuucaauuucaaauugcaguacuuuuaguucuaag

SEQ ID NO: 2246371 - RNA, 84 nt, Homo sapiens
uucuguaagaugaggaagaguuagcagggaaaaggggaggaaaggcuuggagcccugagaaaacuuuguccuuauguuggggaa

SEQ ID NO: 2246372 - RNA, 59 nt, Homo sapiens
ccugcauugcuucacacuaucuuuacuauuuugcauggauagugcuagagaguagcagg

SEQ ID NO: 2246373 - RNA, 69 nt, Homo sapiens
cugauucuaauguggaaauuguuguauuuaaucugaaaaugacuuuaccuacaacaguuccauugucag

SEQ ID NO: 2246374 - RNA, 79 nt, Homo sapiens
aggcuggagugcaauggugcuaucucggcucacugcaagcucugccucccgaguugacgccauuguccugccucagccu

SEQ ID NO: 2246375 - RNA, 66 nt, Homo sapiens
uagaaagaagguuuuugagacacugugaugugugcuuucaucucacaguguuaaaccuuucuuuug

SEQ ID NO: 2246376 - RNA, 83 nt, Homo sapiens
uagcaaaagcuugcugacacccauucaaugugacugguuuugcaaggauuggaaaacaugcacauuggauucagcugcugcua

SEQ ID NO: 2246377 - RNA, 91 nt, Homo sapiens
gccgggcacgguggcuccagcccguaaucccagcacuuuggcaggccaaggugggcggauuaugaggucaggaguucgagaccagccuggc

SEQ ID NO: 2246378 - RNA, 110 nt, Homo sapiens
cuuccacguuuuuggguaucuuuucagcaaugcugcacucuacugguaccaauuuacuguauuaguucauuuuucacacugcugauaaagacauacccgagacugggaag

SEQ ID NO: 2246379 - RNA, 80 nt, Homo sapiens
gagaugaggcaauugaggaugagauggaaaggcucaggauuagccuggggcuuuuucuuguauucucuucuccuuaucuc

SEQ ID NO: 2246380 - RNA, 77 nt, Homo sapiens
uuauacagcugguaaguggcagagauucuggaggcagacugccugcauuugaauucugucgcuuacuagauguauga

SEQ ID NO: 2246381 - RNA, 68 nt, Homo sapiens
cucucucucuagugaguucccagaugaugccagucugcugaucaaugggcuacacauugagugaagag

SEQ ID NO: 2246382 - RNA, 59 nt, Homo sapiens
agcagcaucgggaaguuggccaugaucuuugucuuggggcucaucuauuuggugcugcu

SEQ ID NO: 2246383 - RNA, 60 nt, Homo sapiens
gucacaggaaacuaauaugcgcugucuuggaguggagggagcagauuuguucugugugac

SEQ ID NO: 2246384 - RNA, 71 nt, Homo sapiens
gagcccugggauuguucuccugcaacuagauguucccaucugguggugaugagagacaguaacaaauccuu

SEQ ID NO: 2246385 - RNA, 70 nt, Homo sapiens
gccagcuggcaguggaagugccaguuucuucguguguaaaacaagagaaggcaaucuacugccuacuggc

SEQ ID NO: 2246386 - RNA, 57 nt, Homo sapiens
gaagguggggaccaagaaggaaguauaauucaagaugcuuccaguggccccaucuuu

SEQ ID NO: 2246387 - RNA, 92 nt, Homo sapiens
ggaggcauuggagcccuggggugcugguugggaugaccgccugagccacucuugcuguugcccuuagcacuucagccuucuccauauucucc

SEQ ID NO: 2246388 - RNA, 67 nt, Homo sapiens
cuuuucuucuagucauuuauauuaucucugcaaacuaggagauaagaucauuugcuaagagggaagg

SEQ ID NO: 2246389 - RNA, 64 nt, Homo sapiens
guuuuuuuaauuuacugaaauucuauauuuuguuuauagggauuccaguggcaauuggagaaac

SEQ ID NO: 2246390 - RNA, 75 nt, Homo sapiens
guggguucugguguuacugagccucccaguguccuuuccagauccugggagcuggcgagcaucuccaggauccuc

SEQ ID NO: 2246391 - RNA, 70 nt, Homo sapiens
ggccuugucaccuggggcacagcugaagacuuugcacagguuucuggucuauccuaggugaaugaugguc

SEQ ID NO: 2246392 - RNA, 97 nt, Homo sapiens
ggaguuuugcucuuguugccuaggcuggaguucaguggcgcaaucuuggcucacugcaaccuucaccucccaggucuccagguucaagcgauucucc

SEQ ID NO: 2246393 - RNA, 76 nt, Homo sapiens
auuguaagucauugagucagggaguaucuguuaauauuuacccuuuaugauauguauuccaacucaugaucauaau

SEQ ID NO: 2246394 - RNA, 66 nt, Homo sapiens
gucucuagccaaagcacaauccauugaauauuauuuauuguuuauuagagauauuugguuagggac

SEQ ID NO: 2246395 - RNA, 73 nt, Homo sapiens
gccauuggaggguuaucagggccaugaaauaaucagauguacauuuuaaggcuccuguuggcuuuuaaagggc

SEQ ID NO: 2246396 - RNA, 98 nt, Homo sapiens
gaggugggaggauugcuuguuccccggagguugaagcuacagugagccuugauugugucacugcacuccagccugggcaacagguaagacucugucuc

SEQ ID NO: 2246397 - RNA, 122 nt, Homo sapiens
uuuagaaggguacuuugccugaaucuuaccuucaucccuagaaaaaucagcacaugggugcucaugugcucugccuguuuuuuagagaugauaaaugugaggugcaacaacuugccccuaaa

SEQ ID NO: 2246398 - RNA, 74 nt, Homo sapiens
aguagagauggauuuuaagugaaugaaacauugacuuaguugauguuucauucacuucaaagucucucaguacu

SEQ ID NO: 2246399 - RNA, 102 nt, Homo sapiens
ucacagaaggguguacacuuccugagauauucggaguaauaucauccucuuuucaccuggauauuaugaacacuaucacagcgggguguacacccucuguga

SEQ ID NO: 2246400 - RNA, 79 nt, Homo sapiens
cuuccugccuagagaguuaucaggcuguggcacagggagaaagaacugggcagagccugggggacuuucuggaaggaag

SEQ ID NO: 2246401 - RNA, 91 nt, Homo sapiens
uugauccgguauuuucaguuucaaauccuggaugcacuagcagcaugaugauguguucauggaauuugcaauugagauaaugaggaaucaa

SEQ ID NO: 2246402 - RNA, 57 nt, Homo sapiens
ugagagacaguuucgucggaggcguucuuuggguugcagauggacugcugucucuca

SEQ ID NO: 2246403 - RNA, 115 nt, Homo sapiens
accuacaugagcaagacgcuagauucaaagaauuacauacuguaugguucuguuuauuugacauucucaaaaacaaaccauugcaaugaagaacagauuggugguugccauaggu

SEQ ID NO: 2246404 - RNA, 60 nt, Homo sapiens
guuugacuuucugcucaacagguaguaaagucacucaaaauuuuggacggagagucaaau

SEQ ID NO: 2246405 - RNA, 60 nt, Homo sapiens
cugugccauguuguuuaaaucagagaacuggaagauacuuuauuugaucaucaggcacag

SEQ ID NO: 2246406 - RNA, 80 nt, Homo sapiens
gucacaugcccgacccaaagccaaucacgguggcagaggaagcagagguguugugauuggccuggcgugggucaugugac

SEQ ID NO: 2246407 - RNA, 69 nt, Homo sapiens
guauggguaguacaaaguguauacagagccauaaauauauuuacuguauauauauguauuaugucaggc

SEQ ID NO: 2246408 - RNA, 56 nt, Homo sapiens
auuugcgaggucauggcaauacacauuuucuuaaauguggcaauggccucacagau

SEQ ID NO: 2246409 - RNA, 58 nt, Homo sapiens
uuuccaguuggaagaagggggaugaauagaauauucauccucuucucucagcuagaaa

SEQ ID NO: 2246410 - RNA, 69 nt, Homo sapiens
aggccuuggcaguugacuaaggauacccacuucacgguagacauaguucauuagucaccuagccagcuu

SEQ ID NO: 2246411 - RNA, 67 nt, Homo sapiens
gauuuaugaucggcagugagaguauggagauacaggaucaucuauauacugccugcugauuaguguc

SEQ ID NO: 2246412 - RNA, 60 nt, Homo sapiens
ggauuuuaauguccaaaagaaaaggauuugauaaacccuaauauuuuggauuagaaaucc

SEQ ID NO: 2246413 - RNA, 103 nt, Homo sapiens
ggaugguaagagcacagccacggcaguguggugcggucaggaggcagcauccauccuagcugcacugccgcacucccggguccccugaucccuagaccaugcc

SEQ ID NO: 2246414 - RNA, 59 nt, Homo sapiens
gucugguuccugggagauuucuagagcuaugagcauuuacucccacuugugagcaaggc

SEQ ID NO: 2246415 - RNA, 129 nt, Homo sapiens
caaacacaaucagcaucaccuggaagguuuugagaaugcagaaucucgugcaccaucccagauccacugaaucagaaucugcauuuuaaacaagacuccccagguaaauuauaugcauauuaauguuug

SEQ ID NO: 2246416 - RNA, 59 nt, Homo sapiens
cagcugguguuacaaaccagagcuuguuauguguguguuuuucucuguuccaccaguug

SEQ ID NO: 2246417 - RNA, 68 nt, Homo sapiens
acugggugaaugguuuuuagagaacaauguauuugcauuugcauugugucaaaacauuauucccuagu

SEQ ID NO: 2246418 - RNA, 72 nt, Homo sapiens
guggagggugagaucaauuugggacacaucgacucaaucugagaugggucuuuauuugcucauuuacuccac

SEQ ID NO: 2246419 - RNA, 129 nt, Homo sapiens
acugugugcaugacugugugugucugguugggguggggucaucucauuuguggagagagcuucucuucgagauaaaagggaccucuuccugccagagaugaaagaaugaaaugguuuuaugcaaacggu

SEQ ID NO: 2246420 - RNA, 68 nt, Homo sapiens
ucgcuugaacccaggaggcggagguugcagugagccgauauugugccauugcacuccagccucaguga

SEQ ID NO: 2246421 - RNA, 89 nt, Homo sapiens
ggagaaucgcuugaaccuggaagguggaguuugcagugagcugagaucgcgccauugcacuccagcuugggcgacaagagcgagacucc

SEQ ID NO: 2246422 - RNA, 66 nt, Homo sapiens
ugcuugauuaagccuuguuugcaaaaucaaauaucuacagaugugggcaagaaacacaaucaagua

SEQ ID NO: 2246423 - RNA, 73 nt, Homo sapiens
guggccagagcuguagcauguagcuaccuuuagcugaagguagcugcaaaauauagacuucuaguugggccac

SEQ ID NO: 2246424 - RNA, 57 nt, Homo sapiens
gugggguaggaggaguacuuccuuaagccuacuugcuaaagucacccccugcccuau

SEQ ID NO: 2246425 - RNA, 61 nt, Homo sapiens
ucaggugagugaauguagacuauuuuucaaauagauggcuuugcaauggcauugaccauga

SEQ ID NO: 2246426 - RNA, 68 nt, Homo sapiens
aucuccugugcuuaauuuauaaauugaacuuuauaauuugucaacauauggauucuagcucaguaggu

SEQ ID NO: 2246427 - RNA, 98 nt, Homo sapiens
gaggcaggagaaucgcuugaacucggcagguggagguuguagugagccgagaucacgccacugcacuccagccugaugaaagaguaagacuccgucuc

SEQ ID NO: 2246428 - RNA, 57 nt, Homo sapiens
guagcucuggcucaggauuucccaugaggugguagaugagauguugaucagggcuau

SEQ ID NO: 2246429 - RNA, 74 nt, Homo sapiens
cuauugucagugaguaaagguucauugaauuuuucuucugaugaauaaaauggucaguuuucucagugcaaugg

SEQ ID NO: 2246430 - RNA, 82 nt, Homo sapiens
uggaagaggauucuacagggugcuuauaaaaucuccaagcuuaggaaaaugcacauaaguaguuucuggauauucucuuuua

SEQ ID NO: 2246431 - RNA, 82 nt, Homo sapiens
uaacuauguucugggucacuaggugugaugguuaauuuuguauuaacuugacugagucauugggugcccagagauuugguua

SEQ ID NO: 2246432 - RNA, 102 nt, Homo sapiens
ccaauuguaggaagcagcacuaugugugacuaauaccuaugaucaagauauaaaguggaaaauauggguauuuuauacauaaccugccacuagcagccuugg

SEQ ID NO: 2246433 - RNA, 102 nt, Homo sapiens
gucuaaaauuauguaagaaagucaugaagaggaaaggacagauuaaaaaaucauaaaucuuaccuuauucucucuucagacucauccgugcuguaaauggac

SEQ ID NO: 2246434 - RNA, 60 nt, Homo sapiens
ggugaauuuugcacaauacccaggguguuaguacauuuugcauugcuguaaaggaauacc

SEQ ID NO: 2246435 - RNA, 61 nt, Homo sapiens
uuuuugcuuaaaguccuugugggagucaguagcauuccaugaaacagauuuuaaguaaaag

SEQ ID NO: 2246436 - RNA, 72 nt, Homo sapiens
ggcccugggguccuugccaugugucagcagcugcguugcuguguccugagaucauguguggaccccagggcu

SEQ ID NO: 2246437 - RNA, 64 nt, Homo sapiens
guaaucucagcuacucaggaggcugaggcacuagacucgcuugaaccugggaggcggagguugc

SEQ ID NO: 2246438 - RNA, 68 nt, Homo sapiens
uauggagaaugaugacuuccaauuucauccaugucccuacaaaggacaugaacucaucauuuuuuaug

SEQ ID NO: 2246439 - RNA, 67 nt, Homo sapiens
ccgccccacagguagucccagcugcucccaaggcugaccuaggaggauugcuugagcccgggggugg

SEQ ID NO: 2246440 - RNA, 74 nt, Homo sapiens
guggucucuaaguagaggaaucauuuugugcauuguuuccagagccaccagauuuacuuuacuauuagaaucau

SEQ ID NO: 2246441 - RNA, 82 nt, Homo sapiens
ucuccugucucccuuucuacugcagguggugaagguggcacagcguucauccauacaguuagcaaagguggggaacuggggg

SEQ ID NO: 2246442 - RNA, 68 nt, Homo sapiens
cucacauguacuaggcacugcacaaccccuuauaaaguugguauuguuauugcuuuugugcaggugag

SEQ ID NO: 2246443 - RNA, 58 nt, Homo sapiens
ucagauguuucuuuaacgcaugguugcaaaacgugcuguuaguaaggaacaugacuga

SEQ ID NO: 2246444 - RNA, 66 nt, Homo sapiens
uuuuaugguacuagaguaagaauuguuguuacggaaagacaaacauaaucuuguaguauuauaaga

SEQ ID NO: 2246445 - RNA, 68 nt, Homo sapiens
uuccuucuccccuucuaggacuucggucuccucuucccuuagacugagcccauucuggggagaaggaa

SEQ ID NO: 2246446 - RNA, 75 nt, Homo sapiens
uggaguuaauuuuuuugcacauugugaaaaguacaggucuuaguucaccuucucagugugguaaaaguuuuucca

SEQ ID NO: 2246447 - RNA, 76 nt, Homo sapiens
gagcucuaaaagcuuugagaagaaaaagacacuuaguggcugggugucaucauuccaucagggcuuucagaguguc

SEQ ID NO: 2246448 - RNA, 77 nt, Homo sapiens
agaaaaaagagagagauggggucuuguucuguaccucaggcuacaguacagugacaccauuauagcucgugaauucu

SEQ ID NO: 2246449 - RNA, 59 nt, Homo sapiens
ccagagaacugagugugcuggcggagucugccuucagcugcaguacagucaguucaugg

SEQ ID NO: 2246450 - RNA, 58 nt, Homo sapiens
gacccugcugaucaggucuuaaaguccaaaacucaugagaugucugauugcgaggguc

SEQ ID NO: 2246451 - RNA, 55 nt, Homo sapiens
caggagucugauaguauagauuguaaguaugcagucuguguuuacaggcucucug

SEQ ID NO: 2246452 - RNA, 60 nt, Homo sapiens
ccacaggugaugacauuugaaccaagccuuaaagaauuggcaagaauucuuaccgugugg

SEQ ID NO: 2246453 - RNA, 76 nt, Homo sapiens
cugguaaauauuacaugcuuaacugacauuaacugcuagcagcugcaguagugguaguagcaguaauauuuaccag

SEQ ID NO: 2246454 - RNA, 59 nt, Homo sapiens
ugagauggaguuucgcccuuguuguccagacuggagugcaauggcgagaucuccgcuca

SEQ ID NO: 2246455 - RNA, 71 nt, Homo sapiens
ugcguccgugugaagagaccgccaaacaggcuuugugugagcaacauggcuguuuauuucaccugggugca

SEQ ID NO: 2246456 - RNA, 130 nt, Homo sapiens
aguggcccccuggaucauagcugccuugacaacuuggcagcgcaguugaaaaagaaguaaacuuuugucuucuuuaagucacugcacugcugggcaucuuuguuacagcagcuuaaccuuuaaccacacu

SEQ ID NO: 2246457 - RNA, 60 nt, Homo sapiens
uuucccuuuuuucuaguagguaggucggacacuuagacuuccuacuucugagaggugaga

SEQ ID NO: 2246458 - RNA, 95 nt, Homo sapiens
ccgaaugcagucaaugcccauccacagagggaucauuuaaaccagcccuagccagaggggaaucagauuccagugguuggaacuugagcguuugg

SEQ ID NO: 2246459 - RNA, 66 nt, Homo sapiens
cucuggcccugcauugucaaggccaagccucagcugagguuuugcccacauguagguaugccugag

SEQ ID NO: 2246460 - RNA, 59 nt, Homo sapiens
augagauacuacaaaugaguuuccgguuuccggauccaaucaccuuuguugguauucau

SEQ ID NO: 2246461 - RNA, 92 nt, Homo sapiens
gcccuuaugccuaggaucuugcauauuauaugugccuuauuaaugcuugcaauuguaagugcacuguaagugcaggaugagggcuacagggc

SEQ ID NO: 2246462 - RNA, 78 nt, Homo sapiens
auacuuguugagagaaaaaauuuauugguaaaacuaucucaaagcuuaucaaugaaauuauucuuucauuuugggugu

SEQ ID NO: 2246463 - RNA, 64 nt, Homo sapiens
gcucagcagcgacacccuguggugagagaucuuugacucccagcaacagagugucuugcagggc

SEQ ID NO: 2246464 - RNA, 63 nt, Homo sapiens
ccuaaggcaguagccugaauaauuucaauguauuggauuguuugguuucugucuuuaccaagg

SEQ ID NO: 2246465 - RNA, 96 nt, Homo sapiens
uuugucauggcagcuugagcagaugaauacaccugcuaaaauuuaaaaguguuucagauguuuuguuuaucugcuuuaguuacuugaaauaacaaa

SEQ ID NO: 2246466 - RNA, 61 nt, Homo sapiens
ccaaguguuggcuuguauacaaauguucagaacagauuuauuuguaauagccaaacacugg

SEQ ID NO: 2246467 - RNA, 68 nt, Homo sapiens
cccuggguggccgcgucggguucagcgcuuucugcacuuguggcugaucuguagcagccaccacaggg

SEQ ID NO: 2246468 - RNA, 80 nt, Homo sapiens
aaauuacugucagacacuguggccuuuggaccagcuagaagcuugucacgaaaggugacaguguauguugguggaaauuu

SEQ ID NO: 2246469 - RNA, 100 nt, Homo sapiens
ugaggcuggagaaucgcuugaacccuggagguggagguugcagugagcgagaucaugccauugcacuccagccugggugacagagcgagacuccaucuca

SEQ ID NO: 2246470 - RNA, 93 nt, Homo sapiens
ccacagaagaguacaauuuuuuugcuguaugcaaacaucuccuugaagauugagaaugucuugcaggcaaaagcuacaugcucaggacugugg

SEQ ID NO: 2246471 - RNA, 59 nt, Homo sapiens
uuuacagcacugaagccaggggaauuacguggucccuccccugguguuuggaguuugag

SEQ ID NO: 2246472 - RNA, 58 nt, Homo sapiens
uagaauuuuaccuggaaaaggcaucauggccuuuguacucccuuuagauaaaauucug

SEQ ID NO: 2246473 - RNA, 86 nt, Homo sapiens
gcguccggcggcagcagccuucugcgcugggugcgcgagggguuccucaucaccugagcgggaugcucgccuccucugccggacgc

SEQ ID NO: 2246474 - RNA, 64 nt, Homo sapiens
auuguggauagugcugcaauaaacaugugugugcaugugucuuuuuagcagcaugauuuauaau

SEQ ID NO: 2246475 - RNA, 92 nt, Homo sapiens
ggcuugcuuguauacauacaugucuucucuccccucagggacccuguguuccuugagagaaaaggccaugccuuauguagcucaggaaugcc

SEQ ID NO: 2246476 - RNA, 56 nt, Homo sapiens
ugccugcuaucuauuucuuuuaggcuucuccugccagugaagaaguaggcauggca

SEQ ID NO: 2246477 - RNA, 82 nt, Homo sapiens
auauagguggaaucucaaaauauaugguguuuugugucuggcuucuuucaguuagcaucauguuuucgagguucaccuaugu

SEQ ID NO: 2246478 - RNA, 80 nt, Homo sapiens
guacuccaggguuggaagguacgcuuaggaaaugauacaauguacuuauuuaauauuguccuuugaguuuuauggagugc

SEQ ID NO: 2246479 - RNA, 121 nt, Homo sapiens
uuguaaguuuagcuaaaacucgccuguaaaaucaucuaggucugaugacucuuggagaucuuugauuucuaugguuaccaggcuagucauaauuuuaaguuuucuugagucaaauuuacag

SEQ ID NO: 2246480 - RNA, 73 nt, Homo sapiens
gucuuguucugaucuauuucuacugaauuguugaugauaacuguugacuuuggguaguauagaagcaacaagc

SEQ ID NO: 2246481 - RNA, 87 nt, Homo sapiens
ggucugagcaggacaugaggucaugucgggccccaggacagcagccccuguccuaggcucggcccugacccaccuucucuggaagcc

SEQ ID NO: 2246482 - RNA, 81 nt, Homo sapiens
gauaaccacuguuuuacucucaaauucuaugagacauucuuuuuagaguauacaugugagugagauaaugugguauuuguc

SEQ ID NO: 2246483 - RNA, 59 nt, Homo sapiens
uggaauuaaggcaauugaaagcuacaguccaaaaagagcuuguucauguuuuaguuuca

SEQ ID NO: 2246484 - RNA, 129 nt, Homo sapiens
ucaguuaugaggacuuuuucucugcccuucgucaauaugcagccugugaacagcgucugggaaaguaguggucauugguugcguaauuugauuugaggcuuguggaggaaaggacccaagugacucuga

SEQ ID NO: 2246485 - RNA, 81 nt, Homo sapiens
ggguaauggggaauugacaguguccucauucccaacacucaagggugaugggggauugacacuguccuccccagcaagccu

SEQ ID NO: 2246486 - RNA, 59 nt, Homo sapiens
auuagucauugacauugucugcuccugacauccuagggucaacagugucauggcucaau

SEQ ID NO: 2246487 - RNA, 122 nt, Homo sapiens
uuagauucuaagauucuaagaaucucugcgucuagagguucuaagauucucagagucuggaauucagugcuucugaagucuggaauucucugguuguaagauucuaggauuguaggcacuaa

SEQ ID NO: 2246488 - RNA, 77 nt, Homo sapiens
gcaauaagggaauuucugggauaugaugggggaacgaauauugucaccuccauuugugucaggaagucucaguaugc

SEQ ID NO: 2246489 - RNA, 65 nt, Homo sapiens
caguggggucuguccucuucugggugcucgucagucacuuagaugaagucacagaacccaugcug

SEQ ID NO: 2246490 - RNA, 92 nt, Homo sapiens
agugcccuuagacucccaaauagcaccauugacaagaaauaggugagguuuauauuucaaguuucaagaaucgagguguuaugggcggcacu

SEQ ID NO: 2246491 - RNA, 60 nt, Homo sapiens
auaacuauucuggcuaggacuuucagugcuaugcugaauucaaguagugagagugguuau

SEQ ID NO: 2246492 - RNA, 83 nt, Homo sapiens
cagcuuggacagacugaggucucuguggcuuugcugacucugcuuaagcauucccaccgggucccagcucugcucuaggacug

SEQ ID NO: 2246493 - RNA, 76 nt, Homo sapiens
cacaguuuagcauggagucaugcacggcugcuuauugugagcuagcuguuucauauguacuccugaugaggcugug

SEQ ID NO: 2246494 - RNA, 74 nt, Homo sapiens
acacugcuauaauaaccugggcuugaacagugccuauuagacuagcaccguucaaacccagguuauaguagugu

SEQ ID NO: 2246495 - RNA, 87 nt, Homo sapiens
guuuuaauuuagcaauguaaugcuguucuuugcuuaaguuggauuacagcaguuucauuuuguguaagaauagcauauauuuaaaac

SEQ ID NO: 2246496 - RNA, 66 nt, Homo sapiens
uucuaugcuaugcuauuacucagaaguuaauauugauauuaacaucuagaguuuuggugcuaagaa

SEQ ID NO: 2246497 - RNA, 84 nt, Homo sapiens
uuucuucacuugucuaaagaauggcagacucagaagcaaaacugcaagccugguuccucguucuuuagggaugguguuaugaga

SEQ ID NO: 2246498 - RNA, 65 nt, Homo sapiens
gugcugagaugaauauacucgugcauguaucuuuaugguggcaugauauauauucguuuggguau

SEQ ID NO: 2246499 - RNA, 62 nt, Homo sapiens
ucugguagacucuguaagugaucauacaaaggcuuaaugugaugaucaccaauguuuauaga

SEQ ID NO: 2246500 - RNA, 59 nt, Homo sapiens
agaagagauauuugaccacaugcaucgauugagauguuaaaguucauaguaucucuucu

SEQ ID NO: 2246501 - RNA, 67 nt, Homo sapiens
aucucuccuuugugcucauaauugguuaggccuccuauacccugucgugagucagagaauggacgau

SEQ ID NO: 2246502 - RNA, 56 nt, Homo sapiens
ggcuauccugaggaaauguuguuuggauugaaaucugacaugacuaggagauagcc

SEQ ID NO: 2246503 - RNA, 62 nt, Homo sapiens
agagcuagguugcugagcacaacauuuuugucuauccagacaugauuaguccacuuggcucu

SEQ ID NO: 2246504 - RNA, 86 nt, Homo sapiens
uccuaauccuggacccugugaauauuaccuuauuuggaaaaagggucuucccagguaugguaaugucaaggauuuuaggaugggga

SEQ ID NO: 2246505 - RNA, 77 nt, Homo sapiens
gucacauucauuuuuuaaacaacuuaagauuccaugucauuuaaauaguguuauguuguuugagaaaguccaguggc

SEQ ID NO: 2246506 - RNA, 77 nt, Homo sapiens
uuugcuuuuuauugcuuaugauuagguguuauggcuuucauggacaauauaguugaaugagcaagcacugaaguaaa

SEQ ID NO: 2246507 - RNA, 88 nt, Homo sapiens
cucagguauuucuuuauaacaaugcaagaauggccuaauacguaaaauuaguaccuaggaguggagcacuguuauaaagauuccugag

SEQ ID NO: 2246508 - RNA, 99 nt, Homo sapiens
gaggcaggagaaucacuugaaccugggagguggagguugcagugagcugagaucaugccauugcacuccagccuuggugacagagugagacuccgucuc

SEQ ID NO: 2246509 - RNA, 68 nt, Homo sapiens
uuggauaucauuggccauguuucaaucgaauggagccacugggccccaacacuggcuuugagauuuag

SEQ ID NO: 2246510 - RNA, 77 nt, Homo sapiens
ucuugaaagaugaugcaguacuuugggaacacagcaauaaaaaugugauaauuucccuauugcaucaccuuucuagg

SEQ ID NO: 2246511 - RNA, 55 nt, Homo sapiens
aacaguuaaggggcuaguaaguggcagaaguaggaaucagccccauuagcuaguu

SEQ ID NO: 2246512 - RNA, 109 nt, Homo sapiens
uagauuauguuucauauauauccguguagaagucucugagcuguuguucuuucagcagaucuaauaagcugagagaauucuacacaggacgacuacaaaacauaaucua

SEQ ID NO: 2246513 - RNA, 84 nt, Homo sapiens
gugaaaaaguaacugcacauauuuguaugggucuauuuuggguucuccauucugcuccaucaauguaugugucuauuuuaucac

SEQ ID NO: 2246514 - RNA, 81 nt, Homo sapiens
cuguugaugagaauguaaguuaaugaaaucauuuauauauauguauuuuuuuagggacuugcuccuuauugccaccuacag

SEQ ID NO: 2246515 - RNA, 60 nt, Homo sapiens
ugagacggaguuucgcucuuguuguccaggcuggagugcaauggcgcgaucuccggcuca

SEQ ID NO: 2246516 - RNA, 67 nt, Homo sapiens
ucuuuuguuccaucugcauccaggcagaauugauaauuguucugugcauggcagaggaaugaggaga

SEQ ID NO: 2246517 - RNA, 84 nt, Homo sapiens
ggcuauuuucacuucuuuuguagaucuucaguugcuacaggccaucuggauguacacgugcaggucacaagggauaugauggcu

SEQ ID NO: 2246518 - RNA, 63 nt, Homo sapiens
uuggaauuuuuauaggaauugccuugaaucuguagaucacuuuggguacuauggaaauuuuaa

SEQ ID NO: 2246519 - RNA, 69 nt, Homo sapiens
cacuguccuaagcucuggagauacagucagaacaggaaagauaaaagcucugacuuggaguuuacagug

SEQ ID NO: 2246520 - RNA, 78 nt, Homo sapiens
cccccuugaggaggcagucuaucucuuaguagagcucaagcgcugugcuaggagauccacugcucucuucagagccgg

SEQ ID NO: 2246521 - RNA, 123 nt, Homo sapiens
gaggaggaggccuugauggugcgcauucgagcugaucuuuucugauuccagugggaccucucucugccaaccuccacuaggagucucaaaaagacucagcccugcuucauccagacuccccuc

SEQ ID NO: 2246522 - RNA, 73 nt, Homo sapiens
gaaaguucuauugguaggggcugaggcaucuccaaagguagucucagcucaccauacuaaguuaggauucuuc

SEQ ID NO: 2246523 - RNA, 56 nt, Homo sapiens
uuguacuucagacaugccaaagaccagcuggucuguguguaugcccugaguugcaa

SEQ ID NO: 2246524 - RNA, 81 nt, Homo sapiens
ugcuugagaagaaaaaugcaugaggugggaagaaaagaugaacacgaaacaaucuucuauuuuuccauuucuguguaagca

SEQ ID NO: 2246525 - RNA, 71 nt, Homo sapiens
gcaggauuuccuucuuuuguaaggcugaauauugcauuuaaauauauaccacgcagaaggagaaauacugc

SEQ ID NO: 2246526 - RNA, 66 nt, Homo sapiens
cugucaguaucauuggcauguaaccagaaauauuauuuucuuaugaacuaaaugaugcaaugacag

SEQ ID NO: 2246527 - RNA, 92 nt, Homo sapiens
aggaauacucauggcaguggugaucaccgcuaucauagcuacaauuaaauuacucguugugacugguugucccacuuuccucagguuuucuu

SEQ ID NO: 2246528 - RNA, 59 nt, Homo sapiens
aaccgacuuuuucaaauuguuuuaugcuauguuuuagccuuggaacauaaaaguugguu

SEQ ID NO: 2246529 - RNA, 60 nt, Homo sapiens
ggguucuacuucugggcugccaguuguuagauaugugaccuugggcaagaaguggaacuc

SEQ ID NO: 2246530 - RNA, 90 nt, Homo sapiens
ggcugcacuugagugacauaaagugggggcuguguuggucauguacauagcauaucccacaugucagagauucccuuuuagugccuagcu

SEQ ID NO: 2246531 - RNA, 68 nt, Homo sapiens
ggcugccaguuugauucgggccacugugauauccuggccuaacagugcccugacacaccuggugugcc

SEQ ID NO: 2246532 - RNA, 60 nt, Homo sapiens
uucacguucugccaugauuguaaguuuccugaggccuccccagucaugaagaacugugag

SEQ ID NO: 2246533 - RNA, 63 nt, Homo sapiens
ggcuugggcucuggaggccagcuugcucuuguucugggcuguggccuuuggccaguccgaguc

SEQ ID NO: 2246534 - RNA, 98 nt, Homo sapiens
gaaaucaucuuaagugcauaucuucuuccucauuuauacauacaaagagcuguauggcaaugcauaggaaggaaauggcacaggaaaugaacauuuuc

SEQ ID NO: 2246535 - RNA, 83 nt, Homo sapiens
acacagcuacugaaugguagagucaagauuucaggcuaguucuagaauccaugugcuuuaccauuuugcuauaucaauggugu

SEQ ID NO: 2246536 - RNA, 61 nt, Homo sapiens
ucauuucuccuaagugaaauauacuguuuguuuuccugugugugcauggagggggcaguga

SEQ ID NO: 2246537 - RNA, 56 nt, Homo sapiens
acagcacagcuacuuagguaccaauacuuacguggggagauuaaguaguuggcugu

SEQ ID NO: 2246538 - RNA, 64 nt, Homo sapiens
uuggcagaugagccgcgcuccaagaaccagcuguugaacguuugugagugcaggcuggugccag

SEQ ID NO: 2246539 - RNA, 87 nt, Homo sapiens
gauagauauuuuaaaaaauuaggaaccacagaauugucaaugagaaucucaugauugugaauaugugguuuuggaaaaauauucauc

SEQ ID NO: 2246540 - RNA, 75 nt, Homo sapiens
guguuucucauuauaggacguaguuuaaaaauauaucuguaauauuguucaauucccaccuaugagugagaacau

SEQ ID NO: 2246541 - RNA, 84 nt, Homo sapiens
aguuagccaggcuuggugguacucaucuguagucccagcuacucaggaggcugaggugggagaaucacauaagcuugggaaauu

SEQ ID NO: 2246542 - RNA, 88 nt, Homo sapiens
ggagaauugcuugaaccugggaggcggggguugcagugagccgagauugugccacugcacucccgccugggugacagagcaagacucc

SEQ ID NO: 2246543 - RNA, 60 nt, Homo sapiens
gucacaaagauuugacuuaugcaggcagcucugagcuguauuuugaguuaaucuuugugc

SEQ ID NO: 2246544 - RNA, 89 nt, Homo sapiens
cauggcucacaccuguaauccuggugcuuugggaggcucagacaggagguucacuggagcccaggaguuggaggcugcagugagccaug

SEQ ID NO: 2246545 - RNA, 83 nt, Homo sapiens
uuaugauuuuuaugguuuauuuguaagcagagugcugucccaaaauggaugaaccuguuuaccaguaaaucaguaaacuguaa

SEQ ID NO: 2246546 - RNA, 76 nt, Homo sapiens
gauuccaugguauuguccagaauguuuuuuagauuuuuguuucuagaauguuuuagaccaauacaagcauugaauu

SEQ ID NO: 2246547 - RNA, 75 nt, Homo sapiens
ggguguacacccacugugauauuaaaaggaauaucuuucuagaacauuacaaauaguaucacaagguguacaccc

SEQ ID NO: 2246548 - RNA, 88 nt, Homo sapiens
ggagucucacucuguugccuaggcuggagugcaguggcacuaucuugggucacugcaaccuccaccucccagguucaaguaauucucc

SEQ ID NO: 2246549 - RNA, 62 nt, Homo sapiens
ugguauguuuagaccauuuacauuuaauguaauuauugaugugcuugaauuuaagccuacca

SEQ ID NO: 2246550 - RNA, 63 nt, Homo sapiens
gugagagaaugacuauguguuuugcaagugauuaaauucacaaacacaagucacuuuacuuac

SEQ ID NO: 2246551 - RNA, 87 nt, Homo sapiens
gguaaauuucuuaaauaaugugaacuucuguuucuucaaggcaaguuuguuacagcugugacuugaaacgugaacagaucauuugcc

SEQ ID NO: 2246552 - RNA, 89 nt, Homo sapiens
gcacugucuaccaagcccagcccuacacagacugacucacaccucacagggugggcaggagauguggacuguggcuccugggacggugc

SEQ ID NO: 2246553 - RNA, 127 nt, Homo sapiens
guaggugcauuugcacgcgugugcuguggugugugauguaggugcauuuacacgcgugugcuguggugugugauguaggugcauuugcacgugugugcuguggugugugugaugugugugcauuugc

SEQ ID NO: 2246554 - RNA, 76 nt, Homo sapiens
uucuaauuuucaauuguuauuaguauuuauuauguacccagaguacguaaggaguaguguaacagugcacguagaa

SEQ ID NO: 2246555 - RNA, 103 nt, Homo sapiens
ucuguccuuaacgcuaguaccacacuguuuuaguuauuauagcuuuucaguaaguuuugaaauugagauguguuaguucucccacuuugcuguucauuauaga

SEQ ID NO: 2246556 - RNA, 73 nt, Homo sapiens
guggcagaacagguaggguucugggacccccuuccucauuuccuaagagcaaccucacuuguaucuacucuau

SEQ ID NO: 2246557 - RNA, 62 nt, Homo sapiens
uugagcucucuaaagcacagcuuucuucauggcacuccuauguccugcuuagagagccucag

SEQ ID NO: 2246558 - RNA, 92 nt, Homo sapiens
uuucuucuuuagcuucuaaccucuagcuuacuucaggguccaggcuggagcccuagccuucauucugacaguaggaaggaguaggggagaaa

SEQ ID NO: 2246559 - RNA, 66 nt, Homo sapiens
gaugauguuuaaugcuugaauguuuggaagaagagugcuuugcaaaugucaaggguuaguguuauc

SEQ ID NO: 2246560 - RNA, 70 nt, Homo sapiens
gguuugcaauuucaguuaugauggcuucacugagaaaacaugaagaucuuaggagcugagggagcaagcc

SEQ ID NO: 2246561 - RNA, 69 nt, Homo sapiens
uagggaccaaguggcuuuaagaacuggauuaaaguugauccagugcauucagacacuuggcauucccug

SEQ ID NO: 2246562 - RNA, 75 nt, Homo sapiens
uguuuuuugacuuuuuaacaauagccauucuaacuaguaucuuggaaugguaucuuguugggguuucaauucgca

SEQ ID NO: 2246563 - RNA, 72 nt, Homo sapiens
guugcucucauaucauugcaugcauauggcuuggugaccccaaggccaagucuacugcauuucaguagcaac

SEQ ID NO: 2246564 - RNA, 73 nt, Homo sapiens
cgggacuuugaggaacgcccagucucccaccagcguucuccacggggguaucuggguaguuuucaaggccccg

SEQ ID NO: 2246565 - RNA, 63 nt, Homo sapiens
cugaagaacaccugcugcccaguggcagguguucccagaccacugggcagcagguguucccag

SEQ ID NO: 2246566 - RNA, 66 nt, Homo sapiens
gaaugcaggaaugcacaugccuucgauacacaaaccaaaaaugauacaaugugcaauuuuguauuu

SEQ ID NO: 2246567 - RNA, 66 nt, Homo sapiens
uguccuaacaugcacucugugauuuggaauggugaguauugcagcuugcaggguguguaaagggca

SEQ ID NO: 2246568 - RNA, 56 nt, Homo sapiens
augaauacugcugcaaugaacauaugagugcaugugucuuuuggguagugauuuau

SEQ ID NO: 2246569 - RNA, 68 nt, Homo sapiens
gauuccacuuacuuagcauucccgaaaagacaagguuggggaacagggaauggagugggaaugggguc

SEQ ID NO: 2246570 - RNA, 82 nt, Homo sapiens
aggaaugcagagugcagagggaagaguaagauggcggucagcagccagaaucaagcucguccccuccugacucugcaaaccu

SEQ ID NO: 2246571 - RNA, 82 nt, Homo sapiens
cucagaguguggcuucauguaauauuucacagcuuuccaugcagguucagaaggcugucauuugcaugaauccacuucugag

SEQ ID NO: 2246572 - RNA, 56 nt, Homo sapiens
gggugucuucagcuacauuggguugcccuugacccucauugugauugaagucaucc

SEQ ID NO: 2246573 - RNA, 63 nt, Homo sapiens
uggaagccugcacucgggcagggccuugccccacuggguccuucugcagcugcagguauucua

SEQ ID NO: 2246574 - RNA, 65 nt, Homo sapiens
uguaacuuuuuccagagcauugccuuugguuuuccguagugccaacaugccuggagaugguuaua

SEQ ID NO: 2246575 - RNA, 88 nt, Homo sapiens
uauguugaauagaaguguugaaaguggacauccuugucuuguuccaguucucagggggaaugcuuucaacuuuuccuuguucaauaua

SEQ ID NO: 2246576 - RNA, 104 nt, Homo sapiens
ccaaguggugacuccaauugcagaugcuguacuagaugaugugguuucauugcuugagcaagugaacacaucuccugguaccugguaugcagacauucacuugg

SEQ ID NO: 2246577 - RNA, 60 nt, Homo sapiens
guccuugaggcuuugacuguggcauauuauguguucaguuaacuagcuucaauucuggau

SEQ ID NO: 2246578 - RNA, 76 nt, Homo sapiens
ugguaaaaugucauuuaccagaaucccuggcuuccucccucacuuccccagaugucuggucaaaugucauuuacca

SEQ ID NO: 2246579 - RNA, 119 nt, Homo sapiens
uaauuagcuaauuaauuucaaaauuguguacauguauacaggguuuacuuucuaccacucuacuguagaaagcaaaccucguauacauggucacaauuuugaaauuaauuagcuaauua

SEQ ID NO: 2246580 - RNA, 60 nt, Homo sapiens
uggcuuacaccuguaauccagcacuuugggaggccaaggugggaggguugguguaggcca

SEQ ID NO: 2246581 - RNA, 100 nt, Homo sapiens
uguuugcgcugugaucuuuuuucaugugguauacgcuuauuuauuuauucaccuccuuuacugaacuagacgccauaggcaagagacacagugaugaaca

SEQ ID NO: 2246582 - RNA, 59 nt, Homo sapiens
gacuggguuaguuugaaagacuuucagcucugaaauuauuucuucuacuugaucuaguc

SEQ ID NO: 2246583 - RNA, 72 nt, Homo sapiens
aacugccucguuuuuauuucuguccccauugaaugacacagccaauggcacaagacaugaagaagaggaguu

SEQ ID NO: 2246584 - RNA, 62 nt, Homo sapiens
uagagcgaaguugcuaugauaguacagagacucucuuuguacuccuuggccagcuucuucug

SEQ ID NO: 2246585 - RNA, 97 nt, Homo sapiens
gcugugguggccauggagccaagacucuguuccccuugauaaaaguggaagaaaaauuaaagggaauuuugucuuguaccugaggugccaguucagc

SEQ ID NO: 2246586 - RNA, 57 nt, Homo sapiens
ggcaggaagauggcuuaaauccaggaguuugaggcugcagugagcuaugauccuguc

SEQ ID NO: 2246587 - RNA, 97 nt, Homo sapiens
aaaggacaagaagaaagaaaguugccuaagacauggagcugggacuagaacuccauguggcuaacuuuuaaacccagccuuuuaaccucuguccuuu

SEQ ID NO: 2246588 - RNA, 57 nt, Homo sapiens
ugaauagaaguggcaggaguagguauccuuuacuuguuccugaaaaauucuaauuua

SEQ ID NO: 2246589 - RNA, 77 nt, Homo sapiens
cugguaauucaggggguuaggguugcugaugcagucagggaggccugacugugcaugcccagccccuucaucaccag

SEQ ID NO: 2246590 - RNA, 57 nt, Homo sapiens
gaagcucuuguugaaucuugucaugacacgcaugacuccugagauuacagagccuuc

SEQ ID NO: 2246591 - RNA, 69 nt, Homo sapiens
acuuuuuguggaagauaguguguuaaugugacaaaaauuacaaauguacuuuucuuuccauccaaaagu

SEQ ID NO: 2246592 - RNA, 102 nt, Homo sapiens
aacugaaaacaacgcaugaguaacagacugucacauaaaauuguaagcaacacagcuacuuaauuuagucugaaguauguugcaacgugccaaaauucaguu

SEQ ID NO: 2246593 - RNA, 73 nt, Homo sapiens
agcuugacuucuucaagucuuuggauaauuagcuaugaacagcuaguuccuggggcuugugguccaucaggcu

SEQ ID NO: 2246594 - RNA, 78 nt, Homo sapiens
ggggcagucaguaggaacuguaacuaugucucugaugcaccacguguuuagacacagcacaguccuuuuuucuguucc

SEQ ID NO: 2246595 - RNA, 59 nt, Homo sapiens
uggggauuugaggaaaacacagauuauguuacaugagcuuugcacuuugcaaaucccua

SEQ ID NO: 2246596 - RNA, 77 nt, Homo sapiens
guugugggcucucaauuccauagugucuguggcagaaucuagaguucugccuauuauuauggcauaguuuucauaac

SEQ ID NO: 2246597 - RNA, 96 nt, Homo sapiens
aagggauaaauauguaauagcagcuugucagggcagacuguauucugauguccccacaugguucuguccccuagaagcuguuuacauuauucucuu

SEQ ID NO: 2246598 - RNA, 58 nt, Homo sapiens
uauuuucuuuaaagguuaaaucauaguuauugcuaugauaaguuauuagaagaagaug

SEQ ID NO: 2246599 - RNA, 55 nt, Homo sapiens
agaguaguaggaugaauggacuccagaauaaauaguuuuccucuccuucuacucu

SEQ ID NO: 2246600 - RNA, 58 nt, Homo sapiens
ccuagaagcauauucagaacagagguucauagaaaauuuguuagaaaguguuccuagg

SEQ ID NO: 2246601 - RNA, 60 nt, Homo sapiens
auuuuacaaagugggaaacgaagguuccucuuaggaaccuaguugucaccuuuguauaau

SEQ ID NO: 2246602 - RNA, 78 nt, Homo sapiens
gguaggaaacucauagaauguuugcgccaggugagaccuugucaucaaccugagcuugcauaucauugagcaccuacc

SEQ ID NO: 2246603 - RNA, 55 nt, Homo sapiens
guacaaguuuagccaauuuuauguuauaguaucacaaagugguuuaaacuuguau

SEQ ID NO: 2246604 - RNA, 72 nt, Homo sapiens
uggugcuucuacacuggaggagagcuguugcuauucucaaguugcaagcuuccucucagugacugugcauca

SEQ ID NO: 2246605 - RNA, 93 nt, Homo sapiens
ccuuuguggaagacaguguggugauuccucaaggaucuaaacuagaauuaauauuugacccagcaaucccauuacugcuuauauacccaaagg

SEQ ID NO: 2246606 - RNA, 79 nt, Homo sapiens
ccaugucuugcacuuaccuaagaacuauaggaauucuccauguaccuccuacaguuuuucuagcaguguuggacaaugg

SEQ ID NO: 2246607 - RNA, 129 nt, Homo sapiens
uuuaaauaucacugcacuuaaugaagaaguauuuuugucucugacuagugugauguaguaaaugaaauuguucucauugauuauucaugcagucacugauucaauaaaucaguaguguaugcccuuaaa

SEQ ID NO: 2246608 - RNA, 74 nt, Homo sapiens
agggaacacuucuacacugcuggguugaauguaaacuuguacagucacuauagaaaacaguguggagauuccuu

SEQ ID NO: 2246609 - RNA, 75 nt, Homo sapiens
guuuaucgcaauguuuagaauuuuguuauguucaaucgaggacuuuacaaaauuguguuaaacuuuaugauggau

SEQ ID NO: 2246610 - RNA, 116 nt, Homo sapiens
guauuguauccaacaugcuuguguauguaugucuauuauguagcaggaagguuuuccccgaacaucuauucugcuaucaugcuggaccagguaaacaagcucuuuauaugcaauau

SEQ ID NO: 2246611 - RNA, 63 nt, Homo sapiens
uuucaucuaacaugacuguaugcguagacccaguggagauuucaagcagacauuuggaugaaa

SEQ ID NO: 2246612 - RNA, 90 nt, Homo sapiens
ugucacccuuaacugaguauuucgcuguccucaaaagguuuacaguuaaacaaucuuuuuaguugcucagguauucucuuaggguugaua

SEQ ID NO: 2246613 - RNA, 77 nt, Homo sapiens
uuagcuugacuguuuuugguguauaaaaaugcuagugauguuugcacauugauuuuuauaucuuaagacuuugcuga

SEQ ID NO: 2246614 - RNA, 59 nt, Homo sapiens
gggcauaguaggaagagagaugguuacugugggaacuauaacuuuuaauuuacuggccu

SEQ ID NO: 2246615 - RNA, 56 nt, Homo sapiens
uuauagcagcauaaauggacuaagacagagucuuaaaucaguuugggcugcuauaa

SEQ ID NO: 2246616 - RNA, 88 nt, Homo sapiens
uuuugagaucagguagugugaugcuccuguuuucucuuuauaccuugaagucucaagacaguagccgucacauacaaaaauuacggaa

SEQ ID NO: 2246617 - RNA, 78 nt, Homo sapiens
gcgggaccaucugugagacugguccugaacccaguggccuccaucucugggggcaguuccaucuucaguggucucugc

SEQ ID NO: 2246618 - RNA, 120 nt, Homo sapiens
cauuauuaucucuaucugacauauaaggaaacuggaucccuuaaaguuaaguuaccuguccuggaugacauagcuauuaagugaugccaagucuccuuuauuuuagauguguauauaaug

SEQ ID NO: 2246619 - RNA, 66 nt, Homo sapiens
uugucucucaguguggaggccagaaauuugcaaucaaauuguuggcaggguuauauugagagguga

SEQ ID NO: 2246620 - RNA, 91 nt, Homo sapiens
ggagucuagcagaaauagacaaauuaaaaaugacagcucuggggagaaaagggcuccauuuuccauuucucuaaucugugguuuugacuuc

SEQ ID NO: 2246621 - RNA, 67 nt, Homo sapiens
aagcuucuggcauuuucucugcuugcacucacuuucuccuguugccuugugaagaaggugccugcuu

SEQ ID NO: 2246622 - RNA, 77 nt, Homo sapiens
gauuuucaauccuguugguuaaaucagguuuuaaacauccuuagacccaaaucuggccauacaaggcagagaaaauc

SEQ ID NO: 2246623 - RNA, 55 nt, Homo sapiens
auugaaaaaugacuauugcuuaaguuuguuuucuuaagcugaguguuuuuuuaau

SEQ ID NO: 2246624 - RNA, 106 nt, Homo sapiens
ggaaaacagcuaaacuaauuuuccccaaaucugaacaugucuagaauggucuaaagguuucucaacccuuggcacuacugacauuguaagauguuuagcugcaucc

SEQ ID NO: 2246625 - RNA, 55 nt, Homo sapiens
ggggaaucuaaaagcccuuacagaggucaagccugcagugagcuaagauuacccc

SEQ ID NO: 2246626 - RNA, 87 nt, Homo sapiens
ugguuacuguagcccuauaguauaguuugaagucagguggcgugaugccuccagcuuuguucuuuaugcuuaggauugccuuggcua

SEQ ID NO: 2246627 - RNA, 60 nt, Homo sapiens
cauucauguugcuuguucuacuuaauauauuaagugcuauguggaaagcagcaugauaug

SEQ ID NO: 2246628 - RNA, 127 nt, Homo sapiens
ucacauucuaguguuuuucuguuucgaguguuuucauauugucagguugacuuaauuaucacaauuuugugagguguuaaccaaccuguguuccaaaugaagaaagaaacucaaaaagguuagguga

SEQ ID NO: 2246629 - RNA, 76 nt, Homo sapiens
ccgcccucagugucuggggccccagggcagagggucaccaucuccugcacugggagcagcuccaacauuggggcgg

SEQ ID NO: 2246630 - RNA, 58 nt, Homo sapiens
acuauuggauauuaaucaugacauauacugggcauguuauggauuuauauucuguagu

SEQ ID NO: 2246631 - RNA, 83 nt, Homo sapiens
uccuaucacugcccuugccauauuuuucaggagaggacauuaaguguauaugauggcuucuucuaaaagugggguguguggga

SEQ ID NO: 2246632 - RNA, 55 nt, Homo sapiens
ugacuagagcaauuggaaacaauuguuaaaaauuguuuuuaaaauguccugguua

SEQ ID NO: 2246633 - RNA, 127 nt, Homo sapiens
auguguugcuauaccuaagacugaauaaaugguaaauauuguuguaguuguuggaaaauucuccaggcauugugcaucgaugauuuaagaaguuagauauucaagucaggcgcuguggcucacgcgu

SEQ ID NO: 2246634 - RNA, 55 nt, Homo sapiens
auugucacugugcuccaccagucagaguaagggcuuguggagucaggugaguaau

SEQ ID NO: 2246635 - RNA, 69 nt, Homo sapiens
aaaggagaauacagucccugguuggaaggugcacacagucaagucacagcuaacaacuguuucuucuuu

SEQ ID NO: 2246636 - RNA, 107 nt, Homo sapiens
ugaugauuaaaaaaaaguguuggcuucauaguuuugcuguaaaacuuacuuugggcaauacagauaaagugcuuacagggaacaugaugcguugcaaacacucauca

SEQ ID NO: 2246637 - RNA, 62 nt, Homo sapiens
uuacuugagauggggugucacuauguuggccaggcuggucucgaacuccucaccucaaguga

SEQ ID NO: 2246638 - RNA, 60 nt, Homo sapiens
cucuaaugauacuguguacaagggcaugaaaugaugcucuguggcuccagugucagggag

SEQ ID NO: 2246639 - RNA, 85 nt, Homo sapiens
guauuagguuggugcucaaguaauggcaguuuugccauuacuuucaauggcagaaacugcaauuacuuuggcaccaguuuaguau

SEQ ID NO: 2246640 - RNA, 102 nt, Homo sapiens
gagacaggaggaucgcuugagccuacggaggucaaggcuacagugagucgugacugcaucauuguacucuagccucugggcaacagaaugagauccugucuc

SEQ ID NO: 2246641 - RNA, 62 nt, Homo sapiens
aaugcuuuacuuuuuuggcauuugcaccaguaaaaggagaccugccaagaaaugaggguauu

SEQ ID NO: 2246642 - RNA, 72 nt, Homo sapiens
gcuugaacccaggaggcagaaguugcagugagucgagauagugccauugcacuccagccugggugacagagc

SEQ ID NO: 2246643 - RNA, 64 nt, Homo sapiens
auugugaauaaugccgcaauaaacauacgugugcgugugucuuuguagcagcaugauucauagu

SEQ ID NO: 2246644 - RNA, 72 nt, Homo sapiens
uugucucccagugguagagagauacuuuaggcaaaauaauugaacuucuaaaguacuacuacuguuggauaa

SEQ ID NO: 2246645 - RNA, 117 nt, Homo sapiens
ugagguuuugagcccguucaaaagcuuuuaaauauauagagguuaaguuacuugauuggacugaaucaucagguguguuugaaaaguucucucaagcuuuagcugguucacauuuca

SEQ ID NO: 2246646 - RNA, 98 nt, Homo sapiens
gaggcaggaggaucacuugagcccgggagguuggggcuacagugagcugagaucaugccacugcacuccaaccuggugacaaagugaaauccugccuc

SEQ ID NO: 2246647 - RNA, 85 nt, Homo sapiens
gcugaccuggugcuguagccugauugaggggcacagccuuuuccccagucuuggugucuguagcacguauguucuuagucucagc

SEQ ID NO: 2246648 - RNA, 81 nt, Homo sapiens
aguacacaagucgguguuuccugagaacgaacccugcauguuuagcagcuuuugucucuuagaaacacuagguuuuuugcu

SEQ ID NO: 2246649 - RNA, 123 nt, Homo sapiens
cucccaugcaugcaggcccugacuggggcuggcugagucagucuguccugugcugagcugugggccagccagcgagagggcagagcugggguccugggagaggguguccaugcagaaugggag

SEQ ID NO: 2246650 - RNA, 76 nt, Homo sapiens
guucuuauuugcacucccaucauggugaccauaugacuacugagcaccugaaauguggugagugcaacugaggagc

SEQ ID NO: 2246651 - RNA, 74 nt, Homo sapiens
gguaaauucuauuagcacugagaauggcuugcucauguauguaguauccuucucuguuaaaauauggauuugcc

SEQ ID NO: 2246652 - RNA, 69 nt, Homo sapiens
ggugugugugugugcgugugcucaugcaugcacaagugaauuugcauacacaagcauacauguaccacc

SEQ ID NO: 2246653 - RNA, 70 nt, Homo sapiens
gagccuguaggaggagagguggccgcagucuccacaaaccagcagacuuagccuuuccuccugcuaguuc

SEQ ID NO: 2246654 - RNA, 90 nt, Homo sapiens
accccacaguccccacccuugcagggacagcuuugucaugcggguagcauaguacauguuugaaggugcccaugaagguuggggaggggu

SEQ ID NO: 2246655 - RNA, 73 nt, Homo sapiens
gauugagagaaaaggcagcuguuauauacugaguauauauuauacucuuauucaucuguuuuuucuuaagauu

SEQ ID NO: 2246656 - RNA, 67 nt, Homo sapiens
ggaaauuacuuggucaagaucacagagcaagggaagcucugaacugagaucugaaccaggagugucu

SEQ ID NO: 2246657 - RNA, 60 nt, Homo sapiens
uuacauuuccccauauugagaaccgaauuucucaagucaguuugggagaagcuauuguaa

SEQ ID NO: 2246658 - RNA, 87 nt, Homo sapiens
cagguccugaaggcuggggcuggcaagaugcugaugcaaccagggaaguggggcaacagaccucucugccacccagcccagagccug

SEQ ID NO: 2246659 - RNA, 87 nt, Homo sapiens
uuuuuugcuuaggauugccuuggcuguuuggggucccuuuugauuccauagacauuuuaagguaguuuuuucuaauuuugugaagaa

SEQ ID NO: 2246660 - RNA, 58 nt, Homo sapiens
aacuucugccuggacauccaggcauuuccauacauccucugagaucuaggcagagguu

SEQ ID NO: 2246661 - RNA, 78 nt, Homo sapiens
ugucaguuacacccagagauguccugagugauacagagaauuucugucagucauucacucacucggacaagaaagaca

SEQ ID NO: 2246662 - RNA, 65 nt, Homo sapiens
agucacaugccagcacacccagcuacuucauuuuuuauauagagauggggucuggcuauguugcu

SEQ ID NO: 2246663 - RNA, 56 nt, Homo sapiens
gugguggugugugccuguaaucccagcuacucuggaggcugaggcacuaguaucac

SEQ ID NO: 2246664 - RNA, 68 nt, Homo sapiens
caaguauuuuucuauguacuuagaaugagcaagcucugguuuaccucuugguuauagaaaaauaguug

SEQ ID NO: 2246665 - RNA, 101 nt, Homo sapiens
gugugcauguguggugugaguguaugugcacauauggugcauaagugccuguguggggugguguacugugaugugugauguaugaaucuauguaugugcau

SEQ ID NO: 2246666 - RNA, 57 nt, Homo sapiens
ucucacagaguugaauguuucuuugauugagcaguuuugaaacacucuuuguguaga

SEQ ID NO: 2246667 - RNA, 129 nt, Homo sapiens
uuucuaucccucagucccucaugagcccaguagaauaaauugaugagccauuugacuaaaaauuggugaucagucuauggcugugagaucgacuuauuuuuuaaaugggguuaaacuugcugauagaga

SEQ ID NO: 2246668 - RNA, 108 nt, Homo sapiens
ccugcuagagcugccuuaaaugacuacaaacuugcuggcuuaaaacaauagaaauguaucaucucacuguuuuggaggccagaaguccaaagucaaggcauuagcagg

SEQ ID NO: 2246669 - RNA, 77 nt, Homo sapiens
ccagaaagugaccucacucacacuugggauugauaugguccuccacauuccagauggaguugaggguuucuuucagg

SEQ ID NO: 2246670 - RNA, 59 nt, Homo sapiens
aacgugagcauaggaggcuucuguugacguacuccaacagaagaacuguguuucaaguu

SEQ ID NO: 2246671 - RNA, 75 nt, Homo sapiens
acaugaaauuugugagauagggguggaauaauacaguuaggguguuugucaccucuaaaucucauauuaaaaugu

SEQ ID NO: 2246672 - RNA, 85 nt, Homo sapiens
caaagaaagucuaaaaguauuuugucaaugggaauuuguuuuagcacuuccaagauguuauuccauugucuuuugacuuucauug

SEQ ID NO: 2246673 - RNA, 75 nt, Homo sapiens
ggugcccugagauugggauuguaaaugauuugagguuugucucaaacacuccauaucgcgauucucgggaccgcc

SEQ ID NO: 2246674 - RNA, 75 nt, Homo sapiens
gauggagugagugcaagcaggggaaaugauaggcacuuauaaaaucaucggauccccugaaacucacucauuauc

SEQ ID NO: 2246675 - RNA, 123 nt, Homo sapiens
gcaauguuugaaaguucuaguagaugcuguuuguggaaugcccuuauuuauggugauacaaacagcagcuacuagguaaguacguuccacaaacagccuucuucuagaacuuuuaaacauugu

SEQ ID NO: 2246676 - RNA, 109 nt, Homo sapiens
cagaucaucaggcauuauauuuucauaaggagcacacaaccuagaucucuugcaugcacagcucacaauaguuugugcuccuaugagaaucuaaugugcugcuaaucug

SEQ ID NO: 2246677 - RNA, 93 nt, Homo sapiens
auuugagucacuguggaaagaguaggggacccacaugucgcaagcauaugccauggcaaaugggaccccuacucuuuccacaaugacucaaau

SEQ ID NO: 2246678 - RNA, 65 nt, Homo sapiens
uugacagcguuggguguuauuagauguaaaauuuuuuugacacaucuaaucaucgcaaccuucaa

SEQ ID NO: 2246679 - RNA, 59 nt, Homo sapiens
uugggcaggcuggucuugaacuccugaccucuggugauucaacugcuucagccucccaa

SEQ ID NO: 2246680 - RNA, 109 nt, Homo sapiens
uugagagguacugaagggauguggauggggcauugacagcaucugaccccacaugguucagaugcauccauaccccacuuuuuacuccauccuaucacuacuucuucaa

SEQ ID NO: 2246681 - RNA, 78 nt, Homo sapiens
acucuaucuuagcagaaauauuugucuguuuuauucacucuuugaauuaauuuggcaaaauauugucugguauagagu

SEQ ID NO: 2246682 - RNA, 60 nt, Homo sapiens
uggauuucuauguugaccagucuagaccuuuugucuauucgauguuuacauagauguuua

SEQ ID NO: 2246683 - RNA, 62 nt, Homo sapiens
auguguuuuuaaaugccuuuguuuauagcccuugcucuugaaugguaauuuaguaggcacau

SEQ ID NO: 2246684 - RNA, 62 nt, Homo sapiens
auggugcugggauaacuggcuagccauaugcagauugaaacuggaccccuuccuugcaccau

SEQ ID NO: 2246685 - RNA, 69 nt, Homo sapiens
cagaucuagcaaguggauucugguugauuuuaagaaaauaaauaugacaagagaacacugcuauauuug

SEQ ID NO: 2246686 - RNA, 77 nt, Homo sapiens
uucagcaaagguaguuuccuucauguaccuuauuuuauggcagcugagauagaaaacauaggagaaccuuugcugaa

SEQ ID NO: 2246687 - RNA, 57 nt, Homo sapiens
aagugcaaaucuguggcugaaaggaucauauccccucguccaaacauuugccagcuu

SEQ ID NO: 2246688 - RNA, 81 nt, Homo sapiens
ggaacacgguacccuagagggcuggcauagucugagcacuugcuguccucagcguguggacggccaucuucuuuguguucc

SEQ ID NO: 2246689 - RNA, 78 nt, Homo sapiens
aggaaggagccggugugauggggcuucucucugcucccagcagacgcagacccuccccacacuggccuguccgcuccu

SEQ ID NO: 2246690 - RNA, 66 nt, Homo sapiens
augagguuugggugaggacacagagccaaaccauaucauucugccucuggccccuccaaaucucau

SEQ ID NO: 2246691 - RNA, 58 nt, Homo sapiens
gucugugcauuaauacgugcuguguaaccuaacuucucagcauuauaaugucacagau

SEQ ID NO: 2246692 - RNA, 95 nt, Homo sapiens
uuuuuucucccauucaugcugucagaaauuuauuaaaaagcaaaugaagugugauaauaguuuuuaagugaauuugacagguaaugaagaaaaaa

SEQ ID NO: 2246693 - RNA, 130 nt, Homo sapiens
acaguaauauaaaaguaaauuuucuuuuuuucccuuugaauaagauuuuauguaguauuaaugagagauaagauuuguuuaccucuugaguaaacuacagaaaaaaagggaagaguuuauuucaugcugu

SEQ ID NO: 2246694 - RNA, 87 nt, Homo sapiens
ucaugccaguaacugauagcauucaauuaucuguugacacuugguuaaaaucauaacaugaauugaugcuaggagaaucuagcaugg

SEQ ID NO: 2246695 - RNA, 55 nt, Homo sapiens
gacggaaaguaggaagugaauuugcugugugauugugaacugguuacuuucuguc

SEQ ID NO: 2246696 - RNA, 79 nt, Homo sapiens
cagagcccacggaugcccacagguggugccaccgaguuaacuuugaguagaucaccgugggagauccugccuugcucug

SEQ ID NO: 2246697 - RNA, 129 nt, Homo sapiens
ggcggaucacaacauugaacauaacuauugacacaauucauugccagaaucuaugauaauuuuccacacauuuucuugucuauggaguuugaaugagaaaauccaucaauggccuaccaaugcaucgcc

SEQ ID NO: 2246698 - RNA, 62 nt, Homo sapiens
uuugggaagagguuauuauaguuuauaguuuaaaacaaggacgauaacagcccuuucccaaa

SEQ ID NO: 2246699 - RNA, 86 nt, Homo sapiens
auauguucuaauccucuaauguaaccugcaaauauuaccuuacuuggaaaaagagucuuugcagaugcaguaaaguaagaauguau

SEQ ID NO: 2246700 - RNA, 62 nt, Homo sapiens
auugugaauagugcugcuaaacauacaugugcauaugucuuuauagcagcaugauuuauaau

SEQ ID NO: 2246701 - RNA, 65 nt, Homo sapiens
ucucauacaguaggcacuauuuguauguagcuauugagcacuugaaauguggcuacuguguuaga

SEQ ID NO: 2246702 - RNA, 67 nt, Homo sapiens
gaaggggcugcagcuggagucuaccuaccgugacagcacucccugaagcugcagcaacacaccuuuc

SEQ ID NO: 2246703 - RNA, 61 nt, Homo sapiens
aguagcuguaucugccaccugcuaugccguggugggcacuguauggcauugauuaguuacu

SEQ ID NO: 2246704 - RNA, 84 nt, Homo sapiens
gucagacauuuuauuagcaccaugguagaauaaugguagauaacagucuuccauuauuaguacugugguggaauaacagucccc

SEQ ID NO: 2246705 - RNA, 80 nt, Homo sapiens
gccacucugugucuuucuuauuagaauauuuaauucauuuaaauuuaaguaauuguuaauagggaagcauuugcuguggu

SEQ ID NO: 2246706 - RNA, 65 nt, Homo sapiens
aggucagagcaauguauugcuucugguuuguuaagcaauguguagcagugcauugcuucugauuu

SEQ ID NO: 2246707 - RNA, 57 nt, Homo sapiens
gguaggguauaauuuuacuaucaguuauucugccaugauaagugaaagugcucuauc

SEQ ID NO: 2246708 - RNA, 91 nt, Homo sapiens
ucucaguggcauacaugggaucuauuagguuggugcaaaaguaauggcagaaaccaccauuacuuuugcaccaaccuauagacuacuaaga

SEQ ID NO: 2246709 - RNA, 63 nt, Homo sapiens
gggcucucuuccugccuugcugacuacuucuugcuguaucuucacauggcagagaagaagcuc

SEQ ID NO: 2246710 - RNA, 116 nt, Homo sapiens
gguguccuuugaccguuucccaugaaugaucagucucauuauaggaauauggggugaugcagaaauccaaaguauuccacuggcacugcauuugcaugcaauguucgaaacucacu

SEQ ID NO: 2246711 - RNA, 66 nt, Homo sapiens
uggccagggcacugccaggccacaacagcagccuuccccucccucugcuggcaaaugcuuuggcca

SEQ ID NO: 2246712 - RNA, 55 nt, Homo sapiens
ccccaggcauuugaaacaacacaauuguccagagauugucaaaugucuccugggg

SEQ ID NO: 2246713 - RNA, 59 nt, Homo sapiens
cuucaugaucucugcaaagaccccuuuuccaaauaaggucacauuugcaagaucagaag

SEQ ID NO: 2246714 - RNA, 118 nt, Homo sapiens
guuuguuuguuuguuuuuguucuguuguuuuguuuccaagauaguggauuagaggcuuuuagcaugcuucagcuacuuggaaacagcaagauagugaaugaaagucaacuuugugaac

SEQ ID NO: 2246715 - RNA, 57 nt, Homo sapiens
caguuauacuaguccuguuucuaguguucaauauccauauagggcuagcauauacug

SEQ ID NO: 2246716 - RNA, 61 nt, Homo sapiens
acugagaucuuuaaauaaauaaauggaauauauaccauggucauggguuggaagacucagu

SEQ ID NO: 2246717 - RNA, 99 nt, Homo sapiens
agcugagccuuugguuuggaaaccuuguagccacagguggcaaggaaguuuaagagcgcuuggguggcuugauggcacaagguuucugaacaggcggcu

SEQ ID NO: 2246718 - RNA, 76 nt, Homo sapiens
cacacuagaagaauuuucauaaugcagucacauggugauugugugugauugcauuaugaauauuauuguaugugug

SEQ ID NO: 2246719 - RNA, 75 nt, Homo sapiens
acuuucccguggcucuggggcaugaacucucaguacugcugcuguagaugccucauguucuagguucuggaaggu

SEQ ID NO: 2246720 - RNA, 58 nt, Homo sapiens
agacuugaggccagguugugcccuuguucagcguugggcagaucauuggccucaguuu

SEQ ID NO: 2246721 - RNA, 83 nt, Homo sapiens
gugcuuguggguagaauucaguggguggaugaauaugaaugggaaacauuacaucuucauuuccaaugacauccaacugguac

SEQ ID NO: 2246722 - RNA, 75 nt, Homo sapiens
uccccacugucuggaggccugcaaauaagcaaacaaaaugaacagucuuguuucauggcuugagacccuggagga

SEQ ID NO: 2246723 - RNA, 66 nt, Homo sapiens
guauuucuaguucuagauccuugaggaaucaccacacugucuuccacaaugguugaacuagauuac

SEQ ID NO: 2246724 - RNA, 62 nt, Homo sapiens
gccuggagugcuggaaggaguuuucuagguuuucuuguucuacccucuaguuuucaacaggc

SEQ ID NO: 2246725 - RNA, 81 nt, Homo sapiens
gaggcaaguccuuuucuagggcuccaguaucagaacaagacuuucagauacuggaguccugaaguuuugcacacuucccuc

SEQ ID NO: 2246726 - RNA, 77 nt, Homo sapiens
ugguauuuguugcagcagcacuaucauuucuuaguaccaaauucugucuuagauaauguugcuauaacaaauuacua

SEQ ID NO: 2246727 - RNA, 92 nt, Homo sapiens
aauggcuauaaugucacugagcaauagaaaguuuucaacuucauuauaauuuuuuggauuuuuuuaauguuuguggauacacaguaggcauu

SEQ ID NO: 2246728 - RNA, 65 nt, Homo sapiens
aacuugaucacauggccauuucuagcugcaaaagaugcuuuaguuggguagcuauguguucaguu

SEQ ID NO: 2246729 - RNA, 62 nt, Homo sapiens
uucuucugguuaugaaauuugauuaaaaaaugagauuugggaucaaagccauuaccagagaa

SEQ ID NO: 2246730 - RNA, 60 nt, Homo sapiens
gacaccuugauugcagccuugugaaucagaagauucacuguuaagcaguuaaacuguguc

SEQ ID NO: 2246731 - RNA, 55 nt, Homo sapiens
cuucaccucuaggcuauuaugagucuuugaagcuuugauauuucuggaaguggag

SEQ ID NO: 2246732 - RNA, 62 nt, Homo sapiens
uuccaggucuuccugaauggauuccucuccccauuguggaauauuacagagaggaccuggga

SEQ ID NO: 2246733 - RNA, 79 nt, Homo sapiens
gagacccaucacaaggcaggaaugaaaggggaaauaucuucauucuccuuucuccuguuuucugaucuagcaggaucuc

SEQ ID NO: 2246734 - RNA, 83 nt, Homo sapiens
agagucugucuauugcuuaguguugacccucugcccauggcaaacaccacggaguagacuauuucagcaccaggaaugacuuu

SEQ ID NO: 2246735 - RNA, 82 nt, Homo sapiens
gggguaugguuuuuguacaacagcucuggggagucccggacuccucugagaguggucuacgaacuagcagcaucacuauccc

SEQ ID NO: 2246736 - RNA, 74 nt, Homo sapiens
agucuucaaaaaguccauggaaaauguguauuaucaagaaacugugcauggauugcaaaaucuuuuugagggcu

SEQ ID NO: 2246737 - RNA, 70 nt, Homo sapiens
gagggaggaacaguggcucucauuuugaacuaggauaaacacuucuuggugagaccaauguacuaccuuc

SEQ ID NO: 2246738 - RNA, 75 nt, Homo sapiens
uuagaauucaacaguaaagcauuuuuaaguggcuacauggcuauucuaaaguuuuauuuauugugucaauuuuga

SEQ ID NO: 2246739 - RNA, 62 nt, Homo sapiens
cugcuagaagaucacacacaucacacacgcacugaggugugagcugugguuauuucuggcag

SEQ ID NO: 2246740 - RNA, 74 nt, Homo sapiens
gguuuuggagugauaugguuauaugggaugcccauguaaacagggacccuuuaaccauggcacucagcaggacc

SEQ ID NO: 2246741 - RNA, 85 nt, Homo sapiens
ugcuuguggagugagagaugaugugguagaaaagaagcugcauucauucauucauuuauucauucauuugcucacuccacaagua

SEQ ID NO: 2246742 - RNA, 101 nt, Homo sapiens
gaagaaaggauauuggauugggaguugauucuaggucuggauuauccauaaacuuauuaugggucuuaaaucacuuagugcuucugaaccuuccuuucuuc

SEQ ID NO: 2246743 - RNA, 82 nt, Homo sapiens
aguuuuaggguacacgugcacaacgugcagguuuguuacauauguauacaugugccauguugguaugcuguacccauuagcu

SEQ ID NO: 2246744 - RNA, 68 nt, Homo sapiens
uuuggguagauacccaguaguggaauugcuagauugaauaguagaucuucuauugguuguuugacaaa

SEQ ID NO: 2246745 - RNA, 78 nt, Homo sapiens
agauucucauaggagcacaaaccccauugugaacuucacaugugagggauauagguugagugcuucuuuugagaaucu

SEQ ID NO: 2246746 - RNA, 91 nt, Homo sapiens
auaugcgugcaugcaugugugugaauacauguguguauagagguguaugccuaguguuaauguguguucauguguaugugugagugcaugu

SEQ ID NO: 2246747 - RNA, 72 nt, Homo sapiens
guuguuguuagugguaguuauggauuugcuauaagaauacagcaauugcuaauauauugccaucaaaacaau

SEQ ID NO: 2246748 - RNA, 57 nt, Homo sapiens
uucaguaugauacuagccauauauaggucugucauauauggcuuuuauuauguugag

SEQ ID NO: 2246749 - RNA, 93 nt, Homo sapiens
ggagaggugggauggcuggaugauggacagcccugaagugugggagagauuguuagcaguucaauggguuuucacucaugggcacacagcugc

SEQ ID NO: 2246750 - RNA, 55 nt, Homo sapiens
uuaugcagcaaagugcuugaaacauaaccaaugcuucacuugcacguuugcauag

SEQ ID NO: 2246751 - RNA, 63 nt, Homo sapiens
gcuuuaugguacaugugcacaauguacagguuaguuacauauguauacaugugccauguuggu

SEQ ID NO: 2246752 - RNA, 94 nt, Homo sapiens
cauuuguagauugucuuuggaaaaaaugucuguucaaguccuuugccuacuuuuagauuuuuaaugggcacuuccagaagaggagacccaaaug

SEQ ID NO: 2246753 - RNA, 80 nt, Homo sapiens
uuacuuaaccucucugagacuugguauuguaaucugugaaaaggaaauaaucacaguguucuugugaggguuaaauguag

SEQ ID NO: 2246754 - RNA, 99 nt, Homo sapiens
uugaugugagcggguuccuguacugcaugaagcagggguuugcauccgaaacaaccacccgugcugaauauguaggugauacguugaucuguacagcaa

SEQ ID NO: 2246755 - RNA, 87 nt, Homo sapiens
aguuuaaggcuuuuggguccucugguccuugguuuugggcauguaucuucuaaaaaggaguaaaggggcccagauacauuuugagcu

SEQ ID NO: 2246756 - RNA, 106 nt, Homo sapiens
ucaaacgugucauucuuucccucuguggcuaagacaaccuuuccugucucccaagauuacaugaaagguugucuuaagccauagagggaaagaaugacauguuuga

SEQ ID NO: 2246757 - RNA, 56 nt, Homo sapiens
gaagauggcaucauuuucuuuuaaauaacagauggguaaaagugaugucauucuuu

SEQ ID NO: 2246758 - RNA, 61 nt, Homo sapiens
uuuguccucagcaccugggaagcaucaggaauacaccagcuucucagaggcaggggauaaa

SEQ ID NO: 2246759 - RNA, 76 nt, Homo sapiens
uugcucuauugcccaggcuggagugcaguagcacaaucuuggcugacuacaaccuccaccucccggguucaagcaa

SEQ ID NO: 2246760 - RNA, 58 nt, Homo sapiens
ggggaaauuaucccagaagauaacagaaggguguucuggaacuucaaauaauuucccc

SEQ ID NO: 2246761 - RNA, 76 nt, Homo sapiens
guauuuaucagcaguguaaaaacggacuaauaccguaaguugguaccaguagaguagggcacuguugaaaagauac

SEQ ID NO: 2246762 - RNA, 83 nt, Homo sapiens
gaauucuacucuccugcuuugcaaauggccuuuccaagcagaggcugcugugguggccuguuuggcagaugcagaggauauuc

SEQ ID NO: 2246763 - RNA, 59 nt, Homo sapiens
agggccauugcgguugggaggaggaaaccaucccuagaaucucccaaacagcaggcccu

SEQ ID NO: 2246764 - RNA, 64 nt, Homo sapiens
auugugaauagugcugcaauaaacauacgugugcacaugucuuuauagcagcaugauuuguaau

SEQ ID NO: 2246765 - RNA, 103 nt, Homo sapiens
guuaauauuuuauacccuaucaagugcauaugcuaacgguugcaucugguggacuggugaagucagcuuuggcauaugcacuugcugggguaaaaauauugau

SEQ ID NO: 2246766 - RNA, 77 nt, Homo sapiens
auauuuucagguaaaaaguagaaugaagcauucucagaaacuucuuugagaugugugcauucaacucacagagaugu

SEQ ID NO: 2246767 - RNA, 68 nt, Homo sapiens
caaucccugggaagcagguucucccaaagaaggcagcagcuucuuugggccaugcuucccggucauug

SEQ ID NO: 2246768 - RNA, 78 nt, Homo sapiens
ugguuuuuauuguugguucuguuuaugugauagauuacauuuauugacuugcauaaguugaaccagccuugcaggcca

SEQ ID NO: 2246769 - RNA, 71 nt, Homo sapiens
gcuugaacccggaggcagaguuugcagugagcugagaucaugcuacuguacuccagccugggcaacagagc

SEQ ID NO: 2246770 - RNA, 80 nt, Homo sapiens
ucuuuguuguguuuaguuuaucagugguuucugaagucuccaaguuuuuuagauaguggucagcuaguguuuggcagaga

SEQ ID NO: 2246771 - RNA, 60 nt, Homo sapiens
cuuaccuuugagauagaggccugaggggacagccgggccuuaggcagugucagaggugag

SEQ ID NO: 2246772 - RNA, 87 nt, Homo sapiens
cauuuuuuucuaauacuuuaauaauauuacacuaacacugaaaucuuugaucuugguuuauugugguaugaagugugguuucaagug

SEQ ID NO: 2246773 - RNA, 63 nt, Homo sapiens
caugucuuuuauucugugugaugaaacauucugccuaucuccucacacagaauaaaagaugug

SEQ ID NO: 2246774 - RNA, 89 nt, Homo sapiens
ugcuucaggaaccauuuaaggguauaaagcccauuuuaaagucuuugcugccaaaaugggcuuuauaccgucagcugauuccugaagua

SEQ ID NO: 2246775 - RNA, 85 nt, Homo sapiens
gcugccccugaccugaauccaaacugcacuguagugagaaaauuuuguccuuauaaacaugaagauuugggguuguuacugcagc

SEQ ID NO: 2246776 - RNA, 76 nt, Homo sapiens
cuuacuccaaagcuauagugaucaagacugugugcuaauggcauacagauagacauauauagcucaguggaagaag

SEQ ID NO: 2246777 - RNA, 78 nt, Homo sapiens
cucacuccauugccuaggcuggagugcaguggcacgaucucgguucacugcaaccuccgccucccagguuuaagcgag

SEQ ID NO: 2246778 - RNA, 60 nt, Homo sapiens
ucaucuuuuggauauuuucaucagcugccaccaugcagccugaggucugagaaagaauga

SEQ ID NO: 2246779 - RNA, 57 nt, Homo sapiens
ugacuggagucuugcucugucgcccagacuggaguacaauggcacgauuccggcuca

SEQ ID NO: 2246780 - RNA, 60 nt, Homo sapiens
gcugccguagcaugcauucuccuuacccucaagcguauucaugugcauagccauggcagc

SEQ ID NO: 2246781 - RNA, 60 nt, Homo sapiens
uguauagccacuauuaaagcugcaauugacuaggaauuuuggcuauuucuguggcauaca

SEQ ID NO: 2246782 - RNA, 75 nt, Homo sapiens
guguuuuuggucauugguucuguuuauaugcuggauuacguuuauugauuugcauauguugaaccagccuugcau

SEQ ID NO: 2246783 - RNA, 86 nt, Homo sapiens
ucagcugaaggcagauguuaggaauaguuuguuguuaaucccacccuuuggcaacaaagacauuucaacauccaguaucaggcuga

SEQ ID NO: 2246784 - RNA, 77 nt, Homo sapiens
gcauuuaccacagugccugucuaaugccccaaguauucaauaaauauaaacuauuggccgggcgcgguggcucaugc

SEQ ID NO: 2246785 - RNA, 71 nt, Homo sapiens
ggguagaaaauuauaguagggcaugaauaccagaagguggaauucaugggagcuacuuuaaaagucuaucu

SEQ ID NO: 2246786 - RNA, 56 nt, Homo sapiens
ugagaacggauacuaagggcugggaagaaugcccaguucugaccuaaccuuucuca

SEQ ID NO: 2246787 - RNA, 64 nt, Homo sapiens
aggaugggauguaugauauauguugguguguaccacgcuacuugucauccuugcaucauuuccu

SEQ ID NO: 2246788 - RNA, 69 nt, Homo sapiens
auccuuuggaggauccugagcugauuacuggaagggccaguggauaguaaagucagauucccagagggu

SEQ ID NO: 2246789 - RNA, 59 nt, Homo sapiens
ugagucagaauuuugcucuuguugcccaggcuggagugcaauggcacaaucucugcuca

SEQ ID NO: 2246790 - RNA, 123 nt, Homo sapiens
uuuucaauuuauauaaaaagcaaucuaauucauuauucuccaacgaguguuuguauguauaauacuguugcagauaugagagacauuuguuguagagucugccuuuuacuaaaaguaugaaaa

SEQ ID NO: 2246791 - RNA, 58 nt, Homo sapiens
gugugugugugugugugugugcacgugugcuuauguguacaucucuacacacauguau

SEQ ID NO: 2246792 - RNA, 72 nt, Homo sapiens
uggucauagguugggcguuugauuuuauggcuuuuaggaagcaaaaaaaaucagcgaccuugcuugagauca

SEQ ID NO: 2246793 - RNA, 57 nt, Homo sapiens
cuuggucuagugguagcaccagugccugggaaggcacccguuacuuagcagaccggg

SEQ ID NO: 2246794 - RNA, 65 nt, Homo sapiens
uuaauguaucuaucacaucacauaguuaccaauuuguauauguguguaugugguaagaacauuaa

SEQ ID NO: 2246795 - RNA, 57 nt, Homo sapiens
ggucuuggagaauuguccuggggaaugagagccacccacacagcagcccuccagacc

SEQ ID NO: 2246796 - RNA, 58 nt, Homo sapiens
guaaauagugcugcagucaauguacgugugcaugugucuuuauagcagcaugauuuau

SEQ ID NO: 2246797 - RNA, 69 nt, Homo sapiens
augccuuuguugaccacuauaauugaguuccauuucaugcucacaaaucuaguuggugauacagugcau

SEQ ID NO: 2246798 - RNA, 98 nt, Homo sapiens
agggauguaugguauuuauggcuggguaggaccagaaaugcacuuuguauuacagaguguuaaggcugguugcuauaguauggaacagaaacaccucu

SEQ ID NO: 2246799 - RNA, 94 nt, Homo sapiens
ggcaggagaauugcuugaacccaggggaggagguugcagugagcugagaucgcaccauugcacuccagccuuggggauacagcgagacucuguc

SEQ ID NO: 2246800 - RNA, 114 nt, Homo sapiens
gaaauucgaaaacaaagagaacagcaagaaagauuucagcggugaguaguuugauguuuaaugacugugauauuuuucuucaaauauuuauuguuucuuuuuuuuaaaaauuuu

SEQ ID NO: 2246801 - RNA, 74 nt, Homo sapiens
ggugaaaaggcuuuuugcugacguccuuaccugguggaaugguaagaggugguuucaguagauggccaagcauu

SEQ ID NO: 2246802 - RNA, 99 nt, Homo sapiens
cagaaauccaagcacacuugucuuauauucuuucugcaacccauauuuuuccucuacugguuccagcauaaagcuaauaagacgaagcuugcaauucug

SEQ ID NO: 2246803 - RNA, 61 nt, Homo sapiens
ccucacauguucaggagcacuuagagaagucuuguuuaagguagccacuggacaagagagg

SEQ ID NO: 2246804 - RNA, 76 nt, Homo sapiens
ggagaucuuguuaaaauguggguucugauucagucggucuagggugaggccugaaacugcauuucuaacaagcuuc

SEQ ID NO: 2246805 - RNA, 79 nt, Homo sapiens
guugaaucucuuguguuacauauuuaagagaaggagaaaagaaagcuucuuuugaaagccugugaccaaaagaaagaac

SEQ ID NO: 2246806 - RNA, 94 nt, Homo sapiens
gcagcuggggcucugcagagccaugggguagguagcucggggaaccaggcuggucucuucgagcuugcuucuuuugggugugcucuccagcugc

SEQ ID NO: 2246807 - RNA, 84 nt, Homo sapiens
cauaauggcucauuugcaauagcuucaggagaaggggggguuucuugaaacaucuuuuuccauggauuauuauggcucauugug

SEQ ID NO: 2246808 - RNA, 93 nt, Homo sapiens
caucccuuccgugucauuugccuggagagcuccuacauaucauuaaaccccaacugugaugucccuccuccaggcagcugccgcagacagaug

SEQ ID NO: 2246809 - RNA, 89 nt, Homo sapiens
gaagaucaaugauacuagguuggugcaaaaguaauugugguuuuugccauuuuuuuaaucacuuuggcaccaaccuaauaauuguuuuc

SEQ ID NO: 2246810 - RNA, 65 nt, Homo sapiens
ggugaaucugacaauuaugugucuugggguugcucuucucgaggaguaucuuugugguguucucu

SEQ ID NO: 2246811 - RNA, 82 nt, Homo sapiens
ggggagggagagcugcuaauuuucauuuucaugaggucuugggauuacuuggcauggagugagaauggagguuccccuuccc

SEQ ID NO: 2246812 - RNA, 59 nt, Homo sapiens
guucauagaucaaguaauaagacauuuccuaggguguuuaauuguuugauacuaagagc

SEQ ID NO: 2246813 - RNA, 63 nt, Homo sapiens
gcagugagcagugaguguggugcaggguuaggagcaggcccucagcauccucaugcucagugc

SEQ ID NO: 2246814 - RNA, 79 nt, Homo sapiens
ggagguacguacugcacuggaggccucagauggcccuaggaacuauucuugaggccucuaauguacacugggcuccucc

SEQ ID NO: 2246815 - RNA, 63 nt, Homo sapiens
cuacguguucauguguucucauccuuuagcucccacuuauaagugagaacauguggcauuugg

SEQ ID NO: 2246816 - RNA, 77 nt, Homo sapiens
aaggaacaugagauuugggagggguagggggagaaaugacaugguuuggcuuugugucccuacccgaaucucaccuu

SEQ ID NO: 2246817 - RNA, 82 nt, Homo sapiens
aucaugccuucugcaugugacagcaacccccagccccuuggacaggagcucugggguugcugucacacauggaaggcaugau

SEQ ID NO: 2246818 - RNA, 72 nt, Homo sapiens
gcuuuguaucuccaugucuguaacacaugacuagaaugacuucuugucagugucuuaacagagauuagaagc

SEQ ID NO: 2246819 - RNA, 83 nt, Homo sapiens
gaguuucugcaagucuugacaaugcuucaggcugaaggaacaaugcaucacuucagaaguauuugucaggugaauagaaauuu

SEQ ID NO: 2246820 - RNA, 98 nt, Homo sapiens
uaauguuuuuguuguguuuguguucugacauguuuucaagauuuauaauuuaguuguguuucugugauauguaaacaggaaguagaggagggauauua

SEQ ID NO: 2246821 - RNA, 67 nt, Homo sapiens
acaacugucguuaauuuggcuuugcuuuacucucaccuuguguauaagugaguaauacgucaguugu

SEQ ID NO: 2246822 - RNA, 76 nt, Homo sapiens
agcugaccacgcugaccggcaccauguagugauucccuggaauucuacaugggucgucggugagguccauaaaguu

SEQ ID NO: 2246823 - RNA, 82 nt, Homo sapiens
ccaggaugcugaaguggguuuucucuggaagccaggcccaugacagcuuugcacucugaagaccuacugucagccuucuugg

SEQ ID NO: 2246824 - RNA, 66 nt, Homo sapiens
auggugaaagaggacauccucaucuuguuccucaucuuagaggggaaacauccagucuuucaccau

SEQ ID NO: 2246825 - RNA, 78 nt, Homo sapiens
ggcacaggaaugguggugcugacagccaugcagaaacagugucuauugcacaguguguacagcaccagcagcagugcc

SEQ ID NO: 2246826 - RNA, 58 nt, Homo sapiens
guggacugggagagauaguuccacuuuuaaccugggugggcaccauccccuaggccgc

SEQ ID NO: 2246827 - RNA, 55 nt, Homo sapiens
cagguaguguguagcacagcaguucucaucucagacugcccacuagaacuaccug

SEQ ID NO: 2246828 - RNA, 86 nt, Homo sapiens
uguuauucucuuuugagccuugaugaaaccuauaaagcugaugaguugcuggugucaucaaggcuuuggaggaacagagagagaca

SEQ ID NO: 2246829 - RNA, 68 nt, Homo sapiens
uacuggaaacugauaauauauuagcacuuuauuuacaaugaccuucaaugaaguguuguccuccagua

SEQ ID NO: 2246830 - RNA, 86 nt, Homo sapiens
cuuuauaaauuacccagucuuggguaugccuuuauuagcagugugagaacagacuaauacguaguauauccaugaaauuuauggag

SEQ ID NO: 2246831 - RNA, 58 nt, Homo sapiens
gguuuuuuucccugacgaucggcuuugcaggcuuugugggcuuuguggggaaggagcc

SEQ ID NO: 2246832 - RNA, 58 nt, Homo sapiens
uuugcgcuuuuccuauguugcccuggagagcagaucuagggagcguggaaggugcaga

SEQ ID NO: 2246833 - RNA, 57 nt, Homo sapiens
uguuuucuacuuuguguauugggacaggaacaugacagaauuacaauguagaaaaca

SEQ ID NO: 2246834 - RNA, 60 nt, Homo sapiens
uaugccuuucucacuaagcuuaauuguuuuuagcuuuugacuuaaagugagagaugugug

SEQ ID NO: 2246835 - RNA, 60 nt, Homo sapiens
ccuaauacgauguaaauguguaaaugcuauguaaauaguuguuauacuguauuguuuagg

SEQ ID NO: 2246836 - RNA, 65 nt, Homo sapiens
gaaagaaagaaagaaaugagguuucccugacugagucugggaagcuggcauucauucguucuuuc

SEQ ID NO: 2246837 - RNA, 56 nt, Homo sapiens
augaaaauauucugugccagguagaaaaaauuauuuggcauuccagaaauuuucau

SEQ ID NO: 2246838 - RNA, 93 nt, Homo sapiens
auuagcagugagauuuaguugcauucaugugagagugagauucuaugggauucauucuuaacuccugaguugccacuuugugucaucuuuggu

SEQ ID NO: 2246839 - RNA, 63 nt, Homo sapiens
gugcaggugcaggagucagguccaggacccaugaggcccucagacacugcccuccaccugugc

SEQ ID NO: 2246840 - RNA, 64 nt, Homo sapiens
auugugaauagugccgcaauaaacauacaugugcaugugucuuuguaguagcaugauuuauaau

SEQ ID NO: 2246841 - RNA, 69 nt, Homo sapiens
uuuuagcuaaaucuguaaaaugaggaggguaccauuauccaccuuuagaguuuugagguuuaaaugaga

SEQ ID NO: 2246842 - RNA, 61 nt, Homo sapiens
aaccaguauuggaaaccaggagaagaaccuagacugguucugguguugucaaaugcugguu

SEQ ID NO: 2246843 - RNA, 78 nt, Homo sapiens
gcagaaauuuuguuacugucuuccugauugcuuagggccucuggguaacagacaaggcaguagccaaccguuucaugu

SEQ ID NO: 2246844 - RNA, 89 nt, Homo sapiens
ggaguuucgcucuuguugccuaggcuggaguguaguggcacaaucauggcucaccacaaccuccgccucccggauucaagcgauucucc

SEQ ID NO: 2246845 - RNA, 68 nt, Homo sapiens
ggcuuugccuuaagacuuacuauacaauuacauaacaaguugaauguacuagaaauuaaggcaggguu

SEQ ID NO: 2246846 - RNA, 57 nt, Homo sapiens
uaggccaguauuuuauugagaauuuuuugcguugauguucaucaggauauuggucua

SEQ ID NO: 2246847 - RNA, 85 nt, Homo sapiens
auguaauuuaucaaguacuguacugaaagugaaaaacagaaugguuguauguguacucaaaguacaguuuuuauugaauguauau

SEQ ID NO: 2246848 - RNA, 88 nt, Homo sapiens
ggaucagucuuggauaaacuggugaagaaucggguaguaccaaguucuguuugaagacuauaugauucuucauuaucccacuggggcc

SEQ ID NO: 2246849 - RNA, 79 nt, Homo sapiens
cuaaaaaaaauggagagccaugcuaugcucaugguucagaagacuaauauuaguaagauggcaacucuccacaaauugg

SEQ ID NO: 2246850 - RNA, 63 nt, Homo sapiens
gaggaggcagucuguccauucucagagcucaaacacagugcugggagaaccacugcucucuuc

SEQ ID NO: 2246851 - RNA, 55 nt, Homo sapiens
auacagaggggugaaaguucacagguuauucugugaacagucaucucucuuguau

SEQ ID NO: 2246852 - RNA, 65 nt, Homo sapiens
guucccgcuaugcuacuggauuuguauaaauacugauauucuccaaaccuagugguguagggagc

SEQ ID NO: 2246853 - RNA, 84 nt, Homo sapiens
agucuugcucuguugcuuaggcuggagugcaguggcgcaaucuuggcucacugcaaccuccgccucccagguucaagcgauucu

SEQ ID NO: 2246854 - RNA, 70 nt, Homo sapiens
uucccaagacuucuuucacaauguuucuagggaaugggagucugaaacacacagagaagggagaagggag

SEQ ID NO: 2246855 - RNA, 62 nt, Homo sapiens
ugaaauauugcuuacuaaucaucuucagaggaacuuugugagcuaugaguaagcaaguuuca

SEQ ID NO: 2246856 - RNA, 61 nt, Homo sapiens
cugcuucucaauaccaugugaauuaguuaaauuacauggcaauugggaaauaaaguugcag

SEQ ID NO: 2246857 - RNA, 87 nt, Homo sapiens
augacugcaucucaacucaucacaucucaaucacccugucuccaaaugaggucacagcugagauccugagaguugggacuucagcau

SEQ ID NO: 2246858 - RNA, 68 nt, Homo sapiens
gcuuuggguuucuaauaugcucuaagucaacacuaggauuguguugaucuguguuagaagcuaagagc

SEQ ID NO: 2246859 - RNA, 73 nt, Homo sapiens
guuguuauuagguuggggcaaaaguaauugccauuaaaaacugcaauuacuuuugcaccaaccuaauaguaau

SEQ ID NO: 2246860 - RNA, 55 nt, Homo sapiens
guuauuuaggcuucccagugguaacaugaucucauuuggaagccuauuuaguaac

SEQ ID NO: 2246861 - RNA, 73 nt, Homo sapiens
gggucuaggcauggcacuguguccuggggucagccuggcaggcugaaccccagcagaggccaggcgaugaccu

SEQ ID NO: 2246862 - RNA, 90 nt, Homo sapiens
agcuagcaugauguuauagagguauuaacaguagaagaauuuauuagcaguaaucucuguguauggucccuuucugauguaaugcuagcu

SEQ ID NO: 2246863 - RNA, 55 nt, Homo sapiens
guguccauguguucucaucauuuagcucccacuuaaaagugagaacaugugacau

SEQ ID NO: 2246864 - RNA, 84 nt, Homo sapiens
gaguuaauaggugcagcacaccaacauggcacauguuuacauauggaacaaaccugcauguugugcacauguacccuaaaacuu

SEQ ID NO: 2246865 - RNA, 73 nt, Homo sapiens
gcacaacuaugagucaauuaaaccuguuuccuugauaaauuauccagucucagguaguucuuuauaguagugu

SEQ ID NO: 2246866 - RNA, 66 nt, Homo sapiens
gugucugucuuuugucuuugaaaugcugcuacugaaguggcacuuucaaaagagaagucaugacac

SEQ ID NO: 2246867 - RNA, 78 nt, Homo sapiens
ggaagucaacuugaauauuaggaguagagccucuauauuagcauucaagcuccuacugcuuaaaagucaauuacuuuc

SEQ ID NO: 2246868 - RNA, 67 nt, Homo sapiens
uuaugccuauugugccuuggaucuugaaaaacgugguaaaacuggccaauggugacggcaggcauag

SEQ ID NO: 2246869 - RNA, 113 nt, Homo sapiens
uuaauauacuacuuucuuuuagaauucagugucugcauuuggaacucagacaacaagucagaucauuuguguucuguaaugcagauauggagguagagacaguuuuaaguuaa

SEQ ID NO: 2246870 - RNA, 59 nt, Homo sapiens
caucccugaaaaauuggcuuaacaugaauuggacaugugaaacuauuucucuggggaug

SEQ ID NO: 2246871 - RNA, 84 nt, Homo sapiens
ggguugauccuguuggcuugucagucuccaacaguucucuauacagacgcaaauguucuggagaggcaggccacaggucagccc

SEQ ID NO: 2246872 - RNA, 63 nt, Homo sapiens
aagcagaggguguuaugucaauauuuaaugauagauugauauauugcaugggcuacuuuguuu

SEQ ID NO: 2246873 - RNA, 87 nt, Homo sapiens
ggccugcuguguaugccggacgcuguuuacaaauuggccuuuaagcuuuuuggaaaauugagauguggguuggugacuuagcaggcc

SEQ ID NO: 2246874 - RNA, 73 nt, Homo sapiens
guuuguuuugagaugagucucgcucugucacccaugcuggagugcaguggcacgaucucggcucacugcaaac

SEQ ID NO: 2246875 - RNA, 56 nt, Homo sapiens
uggcuuucuuucaugcaaccucggauuuugugccccagguguauggauggaggcca

SEQ ID NO: 2246876 - RNA, 130 nt, Homo sapiens
uauguguacauacaugcaugcauacacauaugcguacauguaugcaugcaugcaugcauguaaaugcauguauguaugcacacaugcauauguauaugugcaugcauacauacauguauaugcacacaug

SEQ ID NO: 2246877 - RNA, 94 nt, Homo sapiens
cucaaguuaucgacacaaugaguuuaauaugucuguuagacaucugaauggagacguugaauaggcaguuaaguuuaugaguguggagcuuggg

SEQ ID NO: 2246878 - RNA, 70 nt, Homo sapiens
gugugugguaagaucagaacuggaguccagcucuacugacuucuagacuugagugauuucuaucauauac

SEQ ID NO: 2246879 - RNA, 61 nt, Homo sapiens
gggugcuauggucuuuccaauagaugguuguucaaccauugcauugcccuccauaguacuc

SEQ ID NO: 2246880 - RNA, 72 nt, Homo sapiens
cauuccuaugccaagaauccuguucuugaagauaaacuguuaucuuuggugcaugauacuuugucuagaaug

SEQ ID NO: 2246881 - RNA, 80 nt, Homo sapiens
uuagguugagucauuugaaauugccaauauucuaccauuucuggucuacaacaauggcaguuucacauggcucaaccuaa

SEQ ID NO: 2246882 - RNA, 118 nt, Homo sapiens
aucgcuuccacauuuuuagguaucuuuauagcaguagcccccuucugguacuaauuuucuguauuagcccauucuugcacugcuauaaagaacuacucaagacuugguaauuugugau

SEQ ID NO: 2246883 - RNA, 70 nt, Homo sapiens
gagcaucaugauuuccaguuauuauaccucuuaaaacaaguuuaaggaucauggcugggcgugguggcuc

SEQ ID NO: 2246884 - RNA, 64 nt, Homo sapiens
ccgggcacagaguugugagggaacgugggauauccaaagguucuaaguaauuuugcaugccugg

SEQ ID NO: 2246885 - RNA, 123 nt, Homo sapiens
guggccaaacugggauucagacccagggcuguuugguaccacccuuuuuccagaagccgggcaagugucaggccggcuugcuggcaggggucggugggcucugggucccuucccugaagccac

SEQ ID NO: 2246886 - RNA, 79 nt, Homo sapiens
uaaucaaauuagguuagcuguuuuucagcaaauauucuauucuuggacauugugaaugaagaaugcuaaccuuugauug

SEQ ID NO: 2246887 - RNA, 63 nt, Homo sapiens
uugugugacugcucuauuagggcggguuggcacuuugcuugccuuacuaugguguuaggccaa

SEQ ID NO: 2246888 - RNA, 72 nt, Homo sapiens
uuggcaauuuguaucuucuaauauuaucuccuucuaaccauacuggggauaauucuagcagauacaggcuaa

SEQ ID NO: 2246889 - RNA, 60 nt, Homo sapiens
ugacuguucaaggagaggacaacacaaacuuugcauuuguccuccacauuugaucaguca

SEQ ID NO: 2246890 - RNA, 72 nt, Homo sapiens
ggaugagcacagauuccaacuuccuguuacagauucuaaccuccugugacaggauggagaucgguauuaucu

SEQ ID NO: 2246891 - RNA, 72 nt, Homo sapiens
cgugaauuaugguaucucauuuuggauuugaaauguauuucugaaucacagauuaugaguaucuguuucaug

SEQ ID NO: 2246892 - RNA, 58 nt, Homo sapiens
ugagcugagaucgcgccauugcauucuagccugggugacagugugauacuuagucuca

SEQ ID NO: 2246893 - RNA, 93 nt, Homo sapiens
caaacacucagcucccagccaaccguagauuguucugggcugugcgugcagcccgggcacuuugcaguuggcaggcuuugcuagagcuguuug

SEQ ID NO: 2246894 - RNA, 88 nt, Homo sapiens
aguugugugagaugcuauaauuaugauaugacuuaguauaugucaguaauuauaauuguuauguuaaauuguuguaugccacaaaauu

SEQ ID NO: 2246895 - RNA, 68 nt, Homo sapiens
cagcacucaguuacacggccacuucuaacuacaagggagguugggaaauguagccuagcugugugcug

SEQ ID NO: 2246896 - RNA, 60 nt, Homo sapiens
cauaauguaugaggauagguuucuauuaggcuguauguuugagaaaguuuuccucuuaug

SEQ ID NO: 2246897 - RNA, 81 nt, Homo sapiens
ugcuaaguaagugauccaagcuuugcagagagaugucuuuaguguuuucagcacaguguggaucauucauacugcuaggca

SEQ ID NO: 2246898 - RNA, 113 nt, Homo sapiens
auauucuaggccuucaacauaacucugugauuacuuuagucaucaguugcuggguuuuuaaaaauagcagcuuuauugagguaaaucucacauacuauaggagaccagaauau

SEQ ID NO: 2246899 - RNA, 77 nt, Homo sapiens
cuucccagcuacuuugagacuauaaguuacacaaaucugggcuugagugucagauuugccacuuauuagcugggagg

SEQ ID NO: 2246900 - RNA, 65 nt, Homo sapiens
guuuuaucugguuauugcugcugauuauaccaacuguaaaauuaaggcaaagacucagacaagau

SEQ ID NO: 2246901 - RNA, 129 nt, Homo sapiens
auuuacacaccauggcuuuuuaaaaggguuguccuuagauguggccuccagggauaguuaagcuguaaauggaaggcuucauauguaaagacauuuuccuuuugaccuuguuucuuauggugagugugu

SEQ ID NO: 2246902 - RNA, 73 nt, Homo sapiens
gcugauguggcauuucccaaaguauucucugagaacuaguuucucaagaugcucaagggaaaagccacccagu

SEQ ID NO: 2246903 - RNA, 57 nt, Homo sapiens
cauacuuacuguguaccaggugcuauguuugacaccgaagauacaacagugaguaug

SEQ ID NO: 2246904 - RNA, 58 nt, Homo sapiens
auguuucccagagcaaaucuggcuucaccaacugcacagaaaaucuuaugggaaacau

SEQ ID NO: 2246905 - RNA, 129 nt, Homo sapiens
agcauaagccaucuuucucaucuacuuaaugucuagaccuggcaauaaauuuuuguguuguuguuuccaaaguuaaaugaucaaagaucaaaacuuuguugccaucaaagauauuuagaagauugugcu

SEQ ID NO: 2246906 - RNA, 88 nt, Homo sapiens
ggggaauggggcuggcagugugugaggaauuugggugcaggucccgggugaugaugacccaagucacggcugcuuucccccuggccuc

SEQ ID NO: 2246907 - RNA, 70 nt, Homo sapiens
agucaaugcauccaugaauggcuaauaaaaaauuuuuagaauguaaguagucauaucacaugcaguggcu

SEQ ID NO: 2246908 - RNA, 113 nt, Homo sapiens
aagacaucccauuauugaaggagguuuggaagcagagaaagacuaaugugcauuaaagcuuguccucauugguuccaguuuguccuuacuuucuuucaugucacaucugucuu

SEQ ID NO: 2246909 - RNA, 59 nt, Homo sapiens
cuccagguaggaagggagagggugcugcuguucuggcuucagcucaucacugccuggag

SEQ ID NO: 2246910 - RNA, 73 nt, Homo sapiens
caauggguguucaaccuuuaauguucagggauugugcaagucuguguuugaucaagauuguaaacaccuauug

SEQ ID NO: 2246911 - RNA, 82 nt, Homo sapiens
ucucacuuggcuagcuaaauucagcucuagguaagguuaaauccuucucccaugaucuggauuuucaaguuucccagugaga

SEQ ID NO: 2246912 - RNA, 72 nt, Homo sapiens
gucuuuaucagcagcaugcaaauggacuaauacagaaaacugguacugguagugggguguugcuguaaagau

SEQ ID NO: 2246913 - RNA, 80 nt, Homo sapiens
uuugcauuuuuaaucugugacaucucuuuuaccugaauuuaaaggaagaugguguuuucucaccagauuuguaaaguaaa

SEQ ID NO: 2246914 - RNA, 68 nt, Homo sapiens
aggccagcuauaugccaguuguugaaguaugaccuuguaaacaaacuucacaucguuuagcugugccu

SEQ ID NO: 2246915 - RNA, 84 nt, Homo sapiens
aaugcaauacacuugagcauuguguuugacugugagcaacagaaaccgcucaggucuagucuuaaaugcauuagggguugcauu

SEQ ID NO: 2246916 - RNA, 55 nt, Homo sapiens
gaaaugcagguaucagcucuaaccauuucuugggguuugcugauguuugcauuuu

SEQ ID NO: 2246917 - RNA, 55 nt, Homo sapiens
gcacuauggcugcagaggacccaggguccaggcucgucccuguagaccacagugc

SEQ ID NO: 2246918 - RNA, 108 nt, Homo sapiens
cagccggauggagcuggucauaguuuuggccucaggauuagugugcugugugcugucacagacaugucuuguggccguggcuuaugguagcagcugauagucugguug

SEQ ID NO: 2246919 - RNA, 66 nt, Homo sapiens
uugagccuaugagugugugugcacgugagaugggucuccugaauacagcacacugaugggucuuga

SEQ ID NO: 2246920 - RNA, 98 nt, Homo sapiens
guggcagcuuggagacuguaggugggaggaaaaggaauugccaguucaguaaacuuugucaaugcauuauucucccacuucagacuuccgagggccac

SEQ ID NO: 2246921 - RNA, 77 nt, Homo sapiens
aaaaacuguaggacauguacuuguaacagcaauucaucuuucaauucuagucagcaauguucauguucuggguuuuu

SEQ ID NO: 2246922 - RNA, 59 nt, Homo sapiens
guggguaaaucuguuuggggcucucagcucugaaggcuaugagaccccugauuucucac

SEQ ID NO: 2246923 - RNA, 76 nt, Homo sapiens
ugugaagccacacguggcauauaaagauguguucaauuucacauugagcaccuauuaugugucaaguauacgcaca

SEQ ID NO: 2246924 - RNA, 88 nt, Homo sapiens
uugaaaaguguacugcuaugagaaugagauuaugguuacauguaacuacaugggcauuucauuuuuaaagccucuuugaacuuuuuga

SEQ ID NO: 2246925 - RNA, 60 nt, Homo sapiens
ggccagggcugcugggggaguugaagguaccuuggaccccugcucgggagcccugcugcc

SEQ ID NO: 2246926 - RNA, 55 nt, Homo sapiens
uugagauggagucuuguucucucacccaggcuggagugcaauggcuugaucucaa

SEQ ID NO: 2246927 - RNA, 60 nt, Homo sapiens
aaagacaugaaaaucagcuccaaaaaaucaaugauccaggagcugguuuuaugaaucuuu

SEQ ID NO: 2246928 - RNA, 89 nt, Homo sapiens
cgaguauacguuagcaugucagucgccacacgucucagugacgugcgcuucagggcacgugggcgaaauggcauccugacuccaacuug

SEQ ID NO: 2246929 - RNA, 62 nt, Homo sapiens
ugagauccugugacuacacugaccaaaaacauuuauaccagcugauggucacuugauucuca

SEQ ID NO: 2246930 - RNA, 95 nt, Homo sapiens
aagucgggcaugcauagugggaugcucugugaaagaaaguugaaaaauacaguccauggagcaaggcucauuguuacuaggcugagcccagacuu

SEQ ID NO: 2246931 - RNA, 81 nt, Homo sapiens
ucagcuaugugaugguucucuucuccucugagcucacucaugaacaucccgucagauggauagucucacucacauacauga

SEQ ID NO: 2246932 - RNA, 102 nt, Homo sapiens
uauuuaucaucaagcuuucccuguagugccuagaucagauacuuaccuguuuagcccuugugauucugaagagguacugcaaggaagucaaaauguaaagua

SEQ ID NO: 2246933 - RNA, 58 nt, Homo sapiens
acucuacugucuuacagauaucaguuuuucuuccacaugucaacauagacaguagagu

SEQ ID NO: 2246934 - RNA, 76 nt, Homo sapiens
uugcuugagcccaagaguuagagguugcaguaagcagugacugcacuacugcacucuagccugggugacagagcga

SEQ ID NO: 2246935 - RNA, 70 nt, Homo sapiens
uguuagaugccauagcagaauuuggucaagucucuuagugcagggauuuggauggaguuguuaugugaca

SEQ ID NO: 2246936 - RNA, 85 nt, Homo sapiens
ucccaguucuguggauugacuggaccagcugggguaguucucauuuggggucucucaaguggucgcaguuagauagcagcuggga

SEQ ID NO: 2246937 - RNA, 71 nt, Homo sapiens
uaagaugggcucaaacuggagguuguuugaaaauuuaaaaucaaacugcucuuaccagaugggucagcuug

SEQ ID NO: 2246938 - RNA, 83 nt, Homo sapiens
uucauuauucacuccauuucauuuuagcucuugaagucaaaaugggauuccaaagagcaaaauagaaguuuggagaguuugaa

SEQ ID NO: 2246939 - RNA, 97 nt, Homo sapiens
ggucuguuuugcugcccaguguauuuuugggaccugcagcugugucuuggauggaguagggcucaguaaauacuuuggaguuaaaauguauaagacc

SEQ ID NO: 2246940 - RNA, 55 nt, Homo sapiens
uucacaguagggaacugacaaaguugaagggcuuugccagcagccuggcugugaa

SEQ ID NO: 2246941 - RNA, 61 nt, Homo sapiens
aauaccagaggaagcaaaaugguucaugcuucuggaccucaaggaugccuucuucuguauu

SEQ ID NO: 2246942 - RNA, 58 nt, Homo sapiens
agggcaguguuaggacugucuggcucugaaguccaaauuccuucuaaaacgcugcccu

SEQ ID NO: 2246943 - RNA, 75 nt, Homo sapiens
uaugaauaaaugcuuuccuagcaacucugagacucugcauugcgagguagaagagugcuaaggaaguaauuuaua

SEQ ID NO: 2246944 - RNA, 86 nt, Homo sapiens
gaucaacuggaauguccauuugcauaauaagauuagggugggguaaccagccuucccugugcauuauguagacgucauaccugauu

SEQ ID NO: 2246945 - RNA, 62 nt, Homo sapiens
aucauucaggaagagaaauagcacuuguauuaaagaagacucugcauccauuucugagugau

SEQ ID NO: 2246946 - RNA, 55 nt, Homo sapiens
uagcccagugagguugauuugggacuucugaucuccagaaaucuaaacugggcug

SEQ ID NO: 2246947 - RNA, 70 nt, Homo sapiens
aaacauacauugauaagcacuuucuaugugcuaggcgccagcacaugaugcuagguauggaugaauguuu

SEQ ID NO: 2246948 - RNA, 70 nt, Homo sapiens
gugaguuauuauuuauguaaacauauuaaaacuuaugcguguuugcaauauuaugaauauccuaacucgc

SEQ ID NO: 2246949 - RNA, 71 nt, Homo sapiens
uugcaccaauucuaaacaguucuucacuuuguccuauuuuggguugggaguugaauuuagaauugcuguaa

SEQ ID NO: 2246950 - RNA, 75 nt, Homo sapiens
cauuuggauucuaugguuuauuuccaagugugggagacauacugacacaauaaaauaaaccuaggagagaaaaug

SEQ ID NO: 2246951 - RNA, 64 nt, Homo sapiens
augagauuuggaggggccaggggcagaaugauauggcuuggaucugguccccaccaaaucucau

SEQ ID NO: 2246952 - RNA, 83 nt, Homo sapiens
aaagcuuccucauggcccaugccagucaauaugccccccacaaguaaucaacauucuguccuccaugaccauggggugguuuu

SEQ ID NO: 2246953 - RNA, 90 nt, Homo sapiens
uuuauugggguauuaaaugcauuuugacuuacuguggguuuauugagauguaacuucaucauaagucaagaaacaucuauaauugaugaa

SEQ ID NO: 2246954 - RNA, 59 nt, Homo sapiens
gaguagccaguauuuccacagagugggguuacuucuaauuugugcuaaucuggauauuu

SEQ ID NO: 2246955 - RNA, 67 nt, Homo sapiens
guaugaaguuggacuguauaaauuuggccuacaaaaaacggcaauuuuguaugguugaacuugauac

SEQ ID NO: 2246956 - RNA, 56 nt, Homo sapiens
guugguucuguuuaugugacagauuacauuuauugauuugcauauguugaaccagc

SEQ ID NO: 2246957 - RNA, 129 nt, Homo sapiens
cuauauagacguuguacaugccggauuuauuuugaggcgaacgcaaucauuuugaaaugccuaguuuucaaaguaaaaauguguucacguuacaaaaccacuguagcaagacauuucuauuaaaaauag

SEQ ID NO: 2246958 - RNA, 61 nt, Homo sapiens
ucaguagcugaaucaaucaagucaaacaaagaauaucagagcuugaagacuaugcugcuga

SEQ ID NO: 2246959 - RNA, 58 nt, Homo sapiens
ugagacugagucuugcucuauugcccaggcuggaaugcaguagcgcaaucucagcuca

SEQ ID NO: 2246960 - RNA, 58 nt, Homo sapiens
uugcaaggugcagcuuaugcaaggugucuuuuuucuggguaaugagccaaacuugcaa

SEQ ID NO: 2246961 - RNA, 92 nt, Homo sapiens
gccgcgauuaaaagccuuuccacacucacugcauucauacggcuucucuccagugugaaugauggagugucgaauaagguuugcgcuccggc

SEQ ID NO: 2246962 - RNA, 65 nt, Homo sapiens
guggccucugaguaacacagugugacaugccuucaacuaugaucugaauguucuauagaagccgc

SEQ ID NO: 2246963 - RNA, 63 nt, Homo sapiens
gagaguaagagucaaggugacccagagagaaguacacauccucucucccugacucaaauucuu

SEQ ID NO: 2246964 - RNA, 64 nt, Homo sapiens
gcaaagcaucacauaauggaucauggcccauaauaauaauggccaucauuugcugaaugcuugu

SEQ ID NO: 2246965 - RNA, 80 nt, Homo sapiens
gccuccucuaggcuuuuggacccugucucugcaucucuggcagggcgaagagacaguauaccgaaauggccaggccaggc

SEQ ID NO: 2246966 - RNA, 105 nt, Homo sapiens
cuuggagagacuggcccugugccuuccguaugcaguuucuuuacagauuuucugaucugugguaagaaacgcaugucacuuucugacaggccuaggaacuccaag

SEQ ID NO: 2246967 - RNA, 78 nt, Homo sapiens
cagguccuugccaucaucucuuacucagucuauuucauagagcccccugacucagccaggcgugguggcucaugccug

SEQ ID NO: 2246968 - RNA, 121 nt, Homo sapiens
gucccugguacaacucgaaugaagugagugaaaugaaacgcuaugucuuucucuuuacaccgcaagagauguuaaagaaacgugugucauuugcugcacugaauauacggauuccaaggau

SEQ ID NO: 2246969 - RNA, 66 nt, Homo sapiens
cucugccagucauauuacccaauacuuuaacauccacuagauauugcagaaugugaguuggcagag

SEQ ID NO: 2246970 - RNA, 85 nt, Homo sapiens
uaaguucuaggguacagugcacaaugugcagguuuguuacauagguauacaugugccauguugguuugcuguacccgucaacuug

SEQ ID NO: 2246971 - RNA, 56 nt, Homo sapiens
gucugguuuuuuauauccucacuugcugaacuggugccagauguaagaguccaggc

SEQ ID NO: 2246972 - RNA, 101 nt, Homo sapiens
aaaccugaggggucaagagguuaaauagcuugcugaaaauuaguggguauuuaacauacccauuguuaaguugaguaucuaacuuuuacccaacucuguuu

SEQ ID NO: 2246973 - RNA, 72 nt, Homo sapiens
gcuugagcccaggagguugaggcugcagugagcuguguucacaauacugcacuccagccugggugacagagc

SEQ ID NO: 2246974 - RNA, 77 nt, Homo sapiens
uuuaucaauggcuaugccuguagcaggacuucccacuaaucuuuccaagugcauauucaaggcaggccauuuauaaa

SEQ ID NO: 2246975 - RNA, 57 nt, Homo sapiens
uuucauaguuugcauagggcauuugcauagggcaaaugcuuuaguacagacuuggaa

SEQ ID NO: 2246976 - RNA, 130 nt, Homo sapiens
ccucccaaagugcugggauuauaggcaugagccaucaugcccagccuugcaguuuauuuauucuuaaaaaauguaacacagugcggcugggcgagguggcccaugccuguaaucccagcacuuugggagg

SEQ ID NO: 2246977 - RNA, 122 nt, Homo sapiens
ugggaggaacaaggugaggcugugaaggaccuacugauaucuuagcagggggcacagccuccuucuagcaauggcagagugucugugcacaccaggccucaccuguuggacaggaaccccca

SEQ ID NO: 2246978 - RNA, 61 nt, Homo sapiens
aauacaagcaguccaacuccauauuccauaugcuuaacgaguaugaugaacugcuuguauu

SEQ ID NO: 2246979 - RNA, 68 nt, Homo sapiens
aauuugccuggggucaacuuuuaauugcuggagugagcagcacuucacauuguacaaacagguaaguu

SEQ ID NO: 2246980 - RNA, 86 nt, Homo sapiens
uacccagaaagacacauggccucccgcauuugccguuuaucucugcagacaggaaagcuagguguggguguacuguggaucgggug

SEQ ID NO: 2246981 - RNA, 69 nt, Homo sapiens
gcgauucuaaagccuguuguucaggaaucaaucuuuaacaaugauuauagaaguaauggguuuaauugc

SEQ ID NO: 2246982 - RNA, 87 nt, Homo sapiens
ugccuguagcuuucuaauugaccuaaucugauuacuguguguuuuuuaugaaacaguaggcagaauaugucagcaaaguuuuaggua

SEQ ID NO: 2246983 - RNA, 83 nt, Homo sapiens
uaaaugguuauccauuugccaaugggaauuuuccuauaaguaauggauaugggauaguccauuggcaaauaaguacaaauuua

SEQ ID NO: 2246984 - RNA, 73 nt, Homo sapiens
ggguucaaagguaauguuuucuaccaucaaacuaauuacaaauguucauugguaagaaaaccauuauuagcuc

SEQ ID NO: 2246985 - RNA, 108 nt, Homo sapiens
cccauugugagucauggaaucccucaucaugggucucaucaugggccaugggucccaccaugggucaugggagcccccaucaugagucauggaaucccucaucauggg

SEQ ID NO: 2246986 - RNA, 86 nt, Homo sapiens
gccagguaccuguuuguucgucuuguacuauugcuuuaaaacuaaauuauucugcuuuuagaaaaugacauaggcugguaucuggc

SEQ ID NO: 2246987 - RNA, 74 nt, Homo sapiens
gggaggaguggaguaugaaaacugacuuuggcauguugaaaaccaaauucgguauuucggugccuuuucuuucu

SEQ ID NO: 2246988 - RNA, 112 nt, Homo sapiens
ugucucaaaagguucugauuuaauucaccugguguagguccuaagcaucaggguuuuaaaaugcuuccuugguaaguuuaacaugcaucccagguuaagaaccacugagaua

SEQ ID NO: 2246989 - RNA, 85 nt, Homo sapiens
gugguugaaugcucagugaauguuggccacuacuguuuauauuaguagcaguguggacaucauuuauuuugauacaugcgacugc

SEQ ID NO: 2246990 - RNA, 76 nt, Homo sapiens
ccacuguggucuccugucuuggccuucccaaacgggacagguugugucugaaggcaagaagagaaccaucgguugg

SEQ ID NO: 2246991 - RNA, 66 nt, Homo sapiens
auaaauuugaauuguaguacauuugguggucacuuaagugacagcaguacuauaaauuaacuuuau

SEQ ID NO: 2246992 - RNA, 78 nt, Homo sapiens
ucuuuccccuugggcuugggcauagcuuuagggucuucagcacagucuuccaaacagcuaguaccaauccacuaaaga

SEQ ID NO: 2246993 - RNA, 72 nt, Homo sapiens
cgguguccuugaaacaggaagaauucaaauuuauuuggaacguuucuguuuuucaaggguuaacaaucacug

SEQ ID NO: 2246994 - RNA, 55 nt, Homo sapiens
cauggcccuguguggagcugcugcacccugugugaguggugccaugagggccaug

SEQ ID NO: 2246995 - RNA, 59 nt, Homo sapiens
ucuuugucuuuaaacaucuuguucaguaaaccugcugaauacugugcaaaggauuugga

SEQ ID NO: 2246996 - RNA, 56 nt, Homo sapiens
gagccuccuccuggucccuauuauaaaagaacaaaguggucaccuucaggagguuc

SEQ ID NO: 2246997 - RNA, 63 nt, Homo sapiens
gcauaaaggacuauaaggaucaaaaagcaagcagaaaugaauccacauucuaguccuuuaugc

SEQ ID NO: 2246998 - RNA, 85 nt, Homo sapiens
gcauaaucaaagauuagaguagggguggccagauuuuugcacgguaugcaaauggcacacaccuggucuaaccaaucuuucaugc

SEQ ID NO: 2246999 - RNA, 55 nt, Homo sapiens
uugagauggagucuugcacugucgcucagacuggagugcaauggugccaucucgg

SEQ ID NO: 2247000 - RNA, 122 nt, Homo sapiens
ugaggucuguaauuucuuuaauaguuuuguucugguguugggucuugcuuuuagucauugugcuaugguuagguaagauguuaacagcugagauaacugggugaagaauauucagaaacuua

SEQ ID NO: 2247001 - RNA, 59 nt, Homo sapiens
uuucauaguaacaguaacuaugguagguaacuuauuuauaguguuccuuuacuaugaaa

SEQ ID NO: 2247002 - RNA, 59 nt, Homo sapiens
acaggggugguaucuauuuuguuaguggacagacaucacuggaguggugcuucccuugu

SEQ ID NO: 2247003 - RNA, 77 nt, Homo sapiens
cauauauauagcaguauacguacuggguccaauacuucgggugaaaaugaggccuacuguguauaugcuaguauaug

SEQ ID NO: 2247004 - RNA, 67 nt, Homo sapiens
uccuggagagucauuuauaguauuuuggaaaacaagucuaaaacacaaauuuguguucucauuagga

SEQ ID NO: 2247005 - RNA, 77 nt, Homo sapiens
aagagaagacuaagcuuccacuguuuauuuagaacguuuaaggaaccagaaguggguagcugcugcuugacucucuu

SEQ ID NO: 2247006 - RNA, 119 nt, Homo sapiens
ggagacuaaaugugauuacaucaccaccuuacaugccucccugguccgcuguggggaacauugcucuaaagcgcucaaagaggcguuguuggaugggacugucauugcuuuuauccuuc

SEQ ID NO: 2247007 - RNA, 56 nt, Homo sapiens
gugcauacucuggagacauugugccuuuccaaauggcguaaugagagugugaguac

SEQ ID NO: 2247008 - RNA, 67 nt, Homo sapiens
gaugggaaacgauuagucaguggagcauucagaacacacacaaccuuuauugauuaaguuugcuguc

SEQ ID NO: 2247009 - RNA, 82 nt, Homo sapiens
cgagagccuuuguuacaaagugguuuauacaugauugagccugugcaugauguguucaagcuacuuuacggagaagcuuucg

SEQ ID NO: 2247010 - RNA, 60 nt, Homo sapiens
caauggcuucaacuacggcuucaacacaggugugucugagcuuguauuuguagccuguug

SEQ ID NO: 2247011 - RNA, 68 nt, Homo sapiens
uuguauggucugugucacaacuacucaaauccacgggugcagugcaaaagugagcacagacaauacaa

SEQ ID NO: 2247012 - RNA, 62 nt, Homo sapiens
uuacuagaaacagggcuucgccauguugaccaggcuggucucgaacuccuggcuucaaguga

SEQ ID NO: 2247013 - RNA, 75 nt, Homo sapiens
ugugagccaguuuggcuaauuuuggcuaauuuuuguagaaacggggucucgccauguuggccaggcuggucucca

SEQ ID NO: 2247014 - RNA, 58 nt, Homo sapiens
aucagagguacuuuccauuuuucaucugccacacagugcaaagguaguaaccucugau

SEQ ID NO: 2247015 - RNA, 56 nt, Homo sapiens
uagggacugugguacacugugcuauaugacaagguagaggacugaccacagcccua

SEQ ID NO: 2247016 - RNA, 85 nt, Homo sapiens
uuugagaccagguuaugagacugguuaauuuuuguauuuuuuuguagagacaggguuucaccauguuucccaggcuggucucaaa

SEQ ID NO: 2247017 - RNA, 58 nt, Homo sapiens
uuuguugaagugugcucucgccauuguuccaucugugauugagcaccuuuuuugcaga

SEQ ID NO: 2247018 - RNA, 77 nt, Homo sapiens
ccugaggguauuuacaaucacagccagcuuccgcuauuaucaaggauagggaauggcugaugguuccaucucucagg

SEQ ID NO: 2247019 - RNA, 78 nt, Homo sapiens
ugguuuuugucauugguucuguuuauaugcuggauuacauuuauugauuugcauauguugaaccagccuugcauccca

SEQ ID NO: 2247020 - RNA, 130 nt, Homo sapiens
cuuguuuucucuauaugcccuccugccacuauacuguacacugaaugagggcauaugagcaaagacauugcuuuacucacuucucaguuugcagcuuguagaacagggccuggcacauaguagaugcuug

SEQ ID NO: 2247021 - RNA, 77 nt, Homo sapiens
gggucucuucuguguuuauggcaugcucccucucaaccuucccauccaagugugguugugucuaaauaaggagaccu

SEQ ID NO: 2247022 - RNA, 71 nt, Homo sapiens
gccgucagccgaacuuaggguuacucugaaauaugcucuguauauuagaacuagaggaguuugagugaggc

SEQ ID NO: 2247023 - RNA, 111 nt, Homo sapiens
gugauauuagaaguauacuugucugguuuuaaaauuauucauauguuuacaaaugugaggagaugaggagauauuaaauaccauugggcuuuuauauuuauaauuuaucau

SEQ ID NO: 2247024 - RNA, 129 nt, Homo sapiens
cugcacgucagauugaaagcccugguggaguggguucacuagggaucacuuuacccgaggguugcacagauccaugggagaagcaugguucccuggugucacucacucacucaccacuucccugagcag

SEQ ID NO: 2247025 - RNA, 129 nt, Homo sapiens
ggcgugagccacugcacuuggccagugaaaauguuuuuaaauagauaaaggugauagucgcaugaacccagugaaugugaucauugcuguuaaaguguacauuuuucaccaggugugguggaccacgcc

SEQ ID NO: 2247026 - RNA, 56 nt, Homo sapiens
uaugccuuuuggcucaagaaacauugccauauauguugcuugaaccaaaaggcaua

SEQ ID NO: 2247027 - RNA, 88 nt, Homo sapiens
gugagaucauccuuuuggcuugcaugggagcugggugaggccugugacugcuggcuuuccccgaccucccugacaaccuacaugacac

SEQ ID NO: 2247028 - RNA, 129 nt, Homo sapiens
aacagaguaugaaggguuccuugauaugguauaagauuucauauuguaacuaacaaauaagaagugacacuuggugaguuuugguacaguaucaaaaaauaguaugcauaaguaucugaaaaaucuguu

SEQ ID NO: 2247029 - RNA, 59 nt, Homo sapiens
uguccuguaggaggcagaacaaggauuagacugccuaucuguacugucauccugggaca

SEQ ID NO: 2247030 - RNA, 69 nt, Homo sapiens
uggauugagaagcuguggcucaggcacagagaaagaugcccaguuccucccauccugcuucucugucca

SEQ ID NO: 2247031 - RNA, 56 nt, Homo sapiens
uguucugagaaaugcaugcuuuggugauuuuggcauugugugcauaucacagagca

SEQ ID NO: 2247032 - RNA, 55 nt, Homo sapiens
uuccugagagggcugggugcaguggcucacgccuguagucccagcacuuugggaa

SEQ ID NO: 2247033 - RNA, 61 nt, Homo sapiens
guuaccugaaugucuuauugcucguuguaucuagcauacaaacaauagauauucaguaagc

SEQ ID NO: 2247034 - RNA, 62 nt, Homo sapiens
aucaguuaacugucucaggccaugggcgcuauugacauugauaguuggcuuugagaacuggu

SEQ ID NO: 2247035 - RNA, 89 nt, Homo sapiens
uaucuacagcugaguaucuuuaaggugguuugguagcaaauaauaaacaaguguuccaagcauuuuuccagagauacguagaggagaug

SEQ ID NO: 2247036 - RNA, 82 nt, Homo sapiens
cuuggaucucagugcuuguuauuguucuauucggguuuuuaauuucuucagaguuuaauuauagcagguucuuuugucuagg

SEQ ID NO: 2247037 - RNA, 99 nt, Homo sapiens
gagcugauagcacauaguguagacaagugaauacaggauucucuggguuauauuuccagaagucuggaggucauuuggauauuugugggcccuuggcuu

SEQ ID NO: 2247038 - RNA, 66 nt, Homo sapiens
cacuagaaugucagcuucuugagggcagagauuuuuaucuguuuuccagcuguugcauucccagug

SEQ ID NO: 2247039 - RNA, 87 nt, Homo sapiens
agaaacagacaacuauagggcauguguggaguguauguauugcagaccaaaacaucaucccuugcauaggcccugugaccuauuucu

SEQ ID NO: 2247040 - RNA, 94 nt, Homo sapiens
gcuccuuccaucuuuuucuaucaaaaaguguuccauggagaaucuugaauugggucauggagcuuuacuuuauguuuaauaagaggugaggagu

SEQ ID NO: 2247041 - RNA, 72 nt, Homo sapiens
guauagacaugcacauggcuaacuuuuuucuguauuuuuuguagagacaggguuucgccauguugcucauac

SEQ ID NO: 2247042 - RNA, 61 nt, Homo sapiens
agaagauaacugagaaggacuuccccuuaaacaaacuuuagucauuucucagcccucuucu

SEQ ID NO: 2247043 - RNA, 60 nt, Homo sapiens
uugaaguaugaccgcugagaauggccaagacuuagcuauuguuacaggugcauacuccaa

SEQ ID NO: 2247044 - RNA, 80 nt, Homo sapiens
ugcaaagauuauuuugacuauuaaaccaacagaaucuuaucagagacccauguggcaaauggucaggaagaaagucugca

SEQ ID NO: 2247045 - RNA, 85 nt, Homo sapiens
cacacaauauucuugcuugaacuuggugcauucuguugggacacauaaaaaguauuauuaaguuuaagaagacuggccaggugug

SEQ ID NO: 2247046 - RNA, 59 nt, Homo sapiens
ggccuuugaaggguauaggaagugcugggggcugguuccuacugcccauuaaaauggcu

SEQ ID NO: 2247047 - RNA, 79 nt, Homo sapiens
cagaguacaauauauaaugauaaugagcauuguuaggaguauagauagaggugcuuguguuaauauguagcuacuucug

SEQ ID NO: 2247048 - RNA, 78 nt, Homo sapiens
cuucugucaguuugucaaacucauucuccauccaguuuuguucccuugcuggggaagaguugugauccuuuggaggag

SEQ ID NO: 2247049 - RNA, 64 nt, Homo sapiens
auugacaggagagcuuggagugaaagcgagggcuucugaugcaccauuccacuuuccugucagu

SEQ ID NO: 2247050 - RNA, 63 nt, Homo sapiens
uggugauuuuggugauuaaagacauuuguaucuaaaaugucuuugccuaacccaaggucauua

SEQ ID NO: 2247051 - RNA, 121 nt, Homo sapiens
acugcugcguuuucucuucugaacuucugucucugcuugucauggacaguuugcuaauugcuuuaugcggauuagucugcuuccugacuuagaaucaaagugugaguaagaauagaguagu

SEQ ID NO: 2247052 - RNA, 61 nt, Homo sapiens
gauguggagggcuggcccgagugugagagugugcuacucauucaagucaucucuccgcauu

SEQ ID NO: 2247053 - RNA, 56 nt, Homo sapiens
ccuggcaaauugcauucagauuuuaaaugaaauauuugagcaugcagauugccagg

SEQ ID NO: 2247054 - RNA, 62 nt, Homo sapiens
ugagauuuggguggggacacagccaaaccauaucauucugccucuggccccuccaaaucuca

SEQ ID NO: 2247055 - RNA, 61 nt, Homo sapiens
agauuugggaggggccagagacagaaugauauggauuggcuuuguguccccacccaaaucu

SEQ ID NO: 2247056 - RNA, 60 nt, Homo sapiens
ggguuaggaagaacagcugcgaauggccuaauggugcccuaaaguuguuuuauccugccc

SEQ ID NO: 2247057 - RNA, 78 nt, Homo sapiens
aggagcucuuuuagggcaggccugguggugacaaaaugucucagcauuugcuugucuguaaaggauuuuauuucuccu

SEQ ID NO: 2247058 - RNA, 104 nt, Homo sapiens
uugaggcaggagaauugcuugaacccaggagguggaggcuguagugagccaagaucgcaccauggcacuccagccugggcaacaagagcaaaacuccaucucaa

SEQ ID NO: 2247059 - RNA, 75 nt, Homo sapiens
guaaaaaugaguguccaaguaaggugaaauacaaguuuucucauuuuauuuuacuuaccguggaucucuguuuau

SEQ ID NO: 2247060 - RNA, 77 nt, Homo sapiens
uaguuuacugagaaugaugauuuccaguuucauccaggucccugcaaaggacaugagcucaucauuuuuuauggcug

SEQ ID NO: 2247061 - RNA, 60 nt, Homo sapiens
cuagacacugacguuccuccgagaguagaggcguggcucucaggggcaggaugugucugg

SEQ ID NO: 2247062 - RNA, 72 nt, Homo sapiens
uaccuuguaucuguuaggauugcaucuggcuucaagaaacagcccuacuucagcagccuaagcagaaaggua

SEQ ID NO: 2247063 - RNA, 82 nt, Homo sapiens
uuuucugcuguuaauuugucucuuucagguuauuucauagaugcaguuaucaaaaccucagagaguagagcaauagagaaaa

SEQ ID NO: 2247064 - RNA, 84 nt, Homo sapiens
cugccaugucuggcaguugauguugacuguaggcagagagcacaguaggcugcugaccgauguguagcaucgccagcauggcag

SEQ ID NO: 2247065 - RNA, 91 nt, Homo sapiens
uucauuuuuugguaauguuucauugcagauauguagacacuuuguucagucuuaacuugcccuuuguaaugauaauguuaaauuagaugaa

SEQ ID NO: 2247066 - RNA, 75 nt, Homo sapiens
guggugucuaauuugagauauuucuagcuuucugaugugggcauuuggcacuguaaauuucucuuuuaacaccgc

SEQ ID NO: 2247067 - RNA, 66 nt, Homo sapiens
uuuuuuaaauuaaugggagugacaggguggaacauuccacccugucacucccaucaauuugaagaa

SEQ ID NO: 2247068 - RNA, 57 nt, Homo sapiens
uuauuugguugcugacuuggaagaguacagaauuuuaaguuuuaagcaaucugauaa

SEQ ID NO: 2247069 - RNA, 77 nt, Homo sapiens
ggaaauguauuuuggaaucagaggguuaucacaugggucagcccaucauuucauggagccauccuuugaucauuucc

SEQ ID NO: 2247070 - RNA, 70 nt, Homo sapiens
augagguaacagaagcgagcauuuccggggugcgccaugagccuggugaugcuguucacuguguucucau

SEQ ID NO: 2247071 - RNA, 61 nt, Homo sapiens
uuuugguccaguucugugauauugcuguugaucaagggcaaugaaaugaauucgaccagga

SEQ ID NO: 2247072 - RNA, 60 nt, Homo sapiens
gaguccccucuaacccaacuuuauuauguauuaauaauaauaaagcugcucagggggcuc

SEQ ID NO: 2247073 - RNA, 81 nt, Homo sapiens
caccaggaaugcccuggcugacuuugccuggcgaaugacucauugugauucgcagcucaguucaacuagggcuuuuuggug

SEQ ID NO: 2247074 - RNA, 56 nt, Homo sapiens
aggcaugagaaucacuugaacccgggaggcagagguuccagugagccuagaugccu

SEQ ID NO: 2247075 - RNA, 55 nt, Homo sapiens
cuggcagauagaaaugugguuaagaacuuccucuuauaccaggauauuugcucag

SEQ ID NO: 2247076 - RNA, 57 nt, Homo sapiens
gaguacaaggcaggggcucauggcugcuagagcccaucacagagccuuccuugacuc

SEQ ID NO: 2247077 - RNA, 101 nt, Homo sapiens
gggccuuauguuucuuaguuaaaaccugauaauacuuuuauuuugaggaaaaguaguugcuauuuacucagaagaaggauuagagguugaagccauggccc

SEQ ID NO: 2247078 - RNA, 65 nt, Homo sapiens
uggaauaagauaguggaagugggauuaaaaaauggaauuuguuccccuuucucuauuuuagcuca

SEQ ID NO: 2247079 - RNA, 64 nt, Homo sapiens
ccauuuuauuuuaggucaucagaagcuaccagugguggcaugaggccauaaaaguaagccgugg

SEQ ID NO: 2247080 - RNA, 65 nt, Homo sapiens
gugaccuaauuacuuccuuaaaggugucacuucucaauacuauugcaucggugauuagguuucac

SEQ ID NO: 2247081 - RNA, 100 nt, Homo sapiens
ucuaccccuucuagugauuauguggaaauaaaagaaagguuauucuguuuuaaaguaaaauuuuaucauuauauccaucagguucgcuagacaaauuaga

SEQ ID NO: 2247082 - RNA, 56 nt, Homo sapiens
ccaggcuguaguucagugguuauucaaaggcacaaucaucaugcacuacagccugg

SEQ ID NO: 2247083 - RNA, 119 nt, Homo sapiens
uuucuucagcuacaacuugaguccuagaguuacaugaggauuuuuauugucuucaaaaggugaccuugagacaucacaaaauccucaaugaaacucucuagauuaaugcuuuggagaaa

SEQ ID NO: 2247084 - RNA, 57 nt, Homo sapiens
uacauuugaugauugccuuucauacugaguuaggaggugaauguaauuacagaugua

SEQ ID NO: 2247085 - RNA, 76 nt, Homo sapiens
uuauguuauauuggcagaagagaagaugauagcugugaaaaauguagccuucuuugauuuuguuacuaagacauga

SEQ ID NO: 2247086 - RNA, 58 nt, Homo sapiens
agguuugggguuggucaagaugauaaucugucucugacacugaccccaaaaagauccu

SEQ ID NO: 2247087 - RNA, 89 nt, Homo sapiens
ggagaaucacuugaacccgggagguggauauugcagugagcugggaucaugccauugcacuccagccucggcaacaagagugaaacucc

SEQ ID NO: 2247088 - RNA, 66 nt, Homo sapiens
gcacguggcuacccaguuguagaccacauuucuuagcuucucuugcagcuacauguggccaugugc

SEQ ID NO: 2247089 - RNA, 97 nt, Homo sapiens
cagggguaugcuccuccacuuugacuagaguguuuuacaacucuguagaggugaaaguuaacuuguagcaaacugggagugaugcaacuuacuccug

SEQ ID NO: 2247090 - RNA, 56 nt, Homo sapiens
ccauuacacacagaguucuggaguuguacuguuaauguacucuguauguggagugg

SEQ ID NO: 2247091 - RNA, 59 nt, Homo sapiens
caggccugcuguguaugauuuugugggcuaugcagugcauggucauacauggcacccug

SEQ ID NO: 2247092 - RNA, 65 nt, Homo sapiens
ccuguugugcuagguuuuauccuuugucaggugggucuguuuccaucuugaacuuagucaacagg

SEQ ID NO: 2247093 - RNA, 76 nt, Homo sapiens
aggccaggucugugugguuuccagggcucaucaguaagcuaaacuggucuccuugguggccacaagacauuggcuu

SEQ ID NO: 2247094 - RNA, 71 nt, Homo sapiens
guauugguuucugagccccagcaauacaucauuauguauucuaauaugugguugcuugggcacaaccauac

SEQ ID NO: 2247095 - RNA, 65 nt, Homo sapiens
uuaugguauuuugugauaccuuguuccuuuauaugguauaggacaugguaucacaaauaccauaa

SEQ ID NO: 2247096 - RNA, 61 nt, Homo sapiens
guaagugauagaucugggauucagaaccaggucuccuuuccccaggauucuguuacauuac

SEQ ID NO: 2247097 - RNA, 87 nt, Homo sapiens
ggaacuuguugggaacuggagcaaaggugacucuuguuaugcuuuagcauaacaagcaguggcacuuugccccugcccuagagaucu

SEQ ID NO: 2247098 - RNA, 56 nt, Homo sapiens
gugaucucauuuggaauuagaguuguugccaauguaaugaauuaagaugaggucau

SEQ ID NO: 2247099 - RNA, 106 nt, Homo sapiens
ccuggaggaaacgccccauggagauacgggcagagccugguauuuggcaccaaacacaccugagugccugauacccucugucucucacuggcugugugaccccagg

SEQ ID NO: 2247100 - RNA, 71 nt, Homo sapiens
uagguuacuuaaggguguauguauguuacuuaagcuccuauauuguggcaagauacccacuagguuacuua

SEQ ID NO: 2247101 - RNA, 80 nt, Homo sapiens
uauucuguaugauacuguaacagugggugugccucaugacacauuagugaaaacccagugaauguacagcauaaagagug

SEQ ID NO: 2247102 - RNA, 57 nt, Homo sapiens
aaugaguagugcugauggcacuggcacauuacaguggugucuuguuuaauacucauu

SEQ ID NO: 2247103 - RNA, 64 nt, Homo sapiens
aaacucugucuaguuguaaaauuugcucaugaguuagauuggauuugaagucugggcaggguuu

SEQ ID NO: 2247104 - RNA, 91 nt, Homo sapiens
auuuuuuauccuugugcuaaaaugggacuucuaaaguaaguuucucuguguuuuaaaguuaaggagcccauuuuuguuaaggaagaaagau

SEQ ID NO: 2247105 - RNA, 127 nt, Homo sapiens
gcaaauuaacuuaaugaccgaauaauguaguucauggauuuuuacauuuguaguacuggacaucuuggccgguuagcucaguuggugagagcguggugcuaacauuugcaguccuuggaugaauugc

SEQ ID NO: 2247106 - RNA, 72 nt, Homo sapiens
cccugcuagcagaguauagagggcugggcccuggauuaggaguccagagcccuuuauauauccaugggaggg

SEQ ID NO: 2247107 - RNA, 70 nt, Homo sapiens
uuguuuugagacaaggucucaauuugucacccaguuuggagugcaguagugugaucuuggcucacugcag

SEQ ID NO: 2247108 - RNA, 56 nt, Homo sapiens
gucuugggauauguguuacucuguucucaugcugcuaacaaagacauauccaagac

SEQ ID NO: 2247109 - RNA, 70 nt, Homo sapiens
aagucuuugcuauugugaauagugccgcaauaaacauaugugugcaugcaucuuuauaguagcaugauuu

SEQ ID NO: 2247110 - RNA, 99 nt, Homo sapiens
uuccugguaauucggaugcacauuaaaauuaaaguuuuauuuagagcauugguccccuaaguuagguagaaguuuacuuugaaguuugcaagccaggga

SEQ ID NO: 2247111 - RNA, 72 nt, Homo sapiens
cugggcugaagcgguccuccagccuuagccucccaaguaucugagacuagaggcaggcaccgcugcaccugg

SEQ ID NO: 2247112 - RNA, 89 nt, Homo sapiens
cuugaucaugguggauuaucuuuuugauaugcuguugguuuugguuagcuaguauuuucuuaaggauuuuugcaucuauguucaucagg

SEQ ID NO: 2247113 - RNA, 72 nt, Homo sapiens
gccuuugguaaaaugaccacagacauccagaguauuuggauguuggaggaagucauuuuacccuacagaggu

SEQ ID NO: 2247114 - RNA, 66 nt, Homo sapiens
aucaucuccaacaccuguuguuuccugacucuuuaacgaucgccauucuaacuggugugagauggu

SEQ ID NO: 2247115 - RNA, 68 nt, Homo sapiens
ggaaggccacacaugauuuuuaaagagauaauagcagcacuauugucacuuaaaagugcauguuuucc

SEQ ID NO: 2247116 - RNA, 55 nt, Homo sapiens
agugguagagggguuugcacugcagccuacaguagcugcaaagucuuuuccuauu

SEQ ID NO: 2247117 - RNA, 55 nt, Homo sapiens
caggaggcggagguugcagugagcugagaucgcgccauugcacuccagccugcug

SEQ ID NO: 2247118 - RNA, 90 nt, Homo sapiens
ggaagguagugcuugcacuagugcagaggcgcuggcaagccaucucuguaggcuucagggugccucaccauuggcagggaacgcccuucc

SEQ ID NO: 2247119 - RNA, 87 nt, Homo sapiens
gcugagcauguggauaggagugugcacagaguaggucugcaauaaauguccucuaagugaauacagucuuucucccccaucaucagc

SEQ ID NO: 2247120 - RNA, 89 nt, Homo sapiens
ggccuccgaaaagccccucagcaucacaggcagugaguggucccuucugaccucaugccgcaugguccuggcagggucacucggcggcc

SEQ ID NO: 2247121 - RNA, 79 nt, Homo sapiens
gcuagggucaguuuugagaaagcgugcauccaauugugucaugcacagaauuuucucuuuacaaugaacuggacccagu

SEQ ID NO: 2247122 - RNA, 80 nt, Homo sapiens
uuugccguuaauauuagguuggugccaaaguaaucgugguuuuugccauuauuuuugcaccaaccuaauacaucugcaaa

SEQ ID NO: 2247123 - RNA, 69 nt, Homo sapiens
gcugucuuugguucaggcaaggagcgcaaaucugagacugcaguguuccuuguggaaacuauggacggc

SEQ ID NO: 2247124 - RNA, 125 nt, Homo sapiens
uuuccaguauuucaccauuaggaguguuccugcuaugaaugcuuuuggauguaucucccagugaacacaugcaaggauuaauuaaaagcauuccuaagaagggguaaucgguucucaacugggga

SEQ ID NO: 2247125 - RNA, 55 nt, Homo sapiens
ucccaaacuccugggcuccuaggcugaaagaucacuugaggucaggaguuuggga

SEQ ID NO: 2247126 - RNA, 87 nt, Homo sapiens
guuaggaugguacaucccagugaagagaaccuuacgaugugauuugguauguuguuguuucaacuuuucugcauguccuuuccuagc

SEQ ID NO: 2247127 - RNA, 70 nt, Homo sapiens
gaaugcagcuacagguuauccccacauauugacaaauaauauuggucuucaagaccugugaacuucauuc

SEQ ID NO: 2247128 - RNA, 61 nt, Homo sapiens
auauuugcaguguaguuggccagcaagcuacugaagaaauguugguaaguauugcagauau

SEQ ID NO: 2247129 - RNA, 69 nt, Homo sapiens
ggcauugucuacauuaggguuauaugaguucacucgcaagggguugcuguaugguugaagugacaagcc

SEQ ID NO: 2247130 - RNA, 91 nt, Homo sapiens
gcgcccagauggaaucuacauuucuuaaggaggagcaugaaauaucgaagcuaugaagggauucuuggagugugucuuauuccauuggugc

SEQ ID NO: 2247131 - RNA, 101 nt, Homo sapiens
ugaggcaggagaauugcuugaaacugggaggcagagguugcagugagccaggaucuagccauugcacuccagccuggccaacagagcgagacucugucuca

SEQ ID NO: 2247132 - RNA, 70 nt, Homo sapiens
uauauguggcuuuucaacugugugagggguuggcacacuuaucugucacaauguuaaagggucaacugua

SEQ ID NO: 2247133 - RNA, 70 nt, Homo sapiens
gguagggaguuuuggggugcagaaggguacuggagcuaauuuuuucuuccaguuucccagcuacccugcc

SEQ ID NO: 2247134 - RNA, 76 nt, Homo sapiens
auccuuuauaauaaaccaguaguucccugaguugugugaaacacuuuagcaaaucaauggaauugaaggagggggu

SEQ ID NO: 2247135 - RNA, 64 nt, Homo sapiens
gcaacucugucuccuucaaguucaccggccucacgccaguagccgggacagagacaggaucugu

SEQ ID NO: 2247136 - RNA, 118 nt, Homo sapiens
guuucuacuuaagugaaucagaucaaaaauguaauuauugacucauagaaaggauguacuacaaagaagaaauacacuugauuuauaaagaguuaauuuugaagugauuuuuagaaac

SEQ ID NO: 2247137 - RNA, 64 nt, Homo sapiens
ggagauuauugaaucaugagggugguuucccccuauacuguucucaugguaguaaauaaguuuc

SEQ ID NO: 2247138 - RNA, 73 nt, Homo sapiens
uccaggcuaggcaugugugcagacugucugugugcauguauaggcgaguguguuugcacacaugcuguguggg

SEQ ID NO: 2247139 - RNA, 130 nt, Homo sapiens
cuucacauauguuuucauuuuuuucaucccaauucuaugaggcauuauucccaucuuacaccuagguauagcuguguagaugauaauguuauaaaaugcuaacugggaaaaaaagucuugcuuauugaag

SEQ ID NO: 2247140 - RNA, 129 nt, Homo sapiens
agacacaaacgcugacuucagauuguuuacaguucgagagaaaaggcauauaugcaauguccaaugucuuguaaugcaccuuugcuuucugaaucugcuccccaucuuugaaucuccugaauucugucu

SEQ ID NO: 2247141 - RNA, 120 nt, Homo sapiens
gaaguauguuuuuaaaugucuugcaagaaauagguuggaaacuuuaacaaagaucucuagacuugaauuuagagcuaguuuuuaaucuaacuuguagaaacuaaguuaauaacuuacuuu

SEQ ID NO: 2247142 - RNA, 94 nt, Homo sapiens
uuuauuuucagguaauuaugguuugucuucucaacaccagccaguuucuauauuaggauaaagggagauuaaacuauaauauuuguuuuguaaa

SEQ ID NO: 2247143 - RNA, 70 nt, Homo sapiens
uugcuaaguuacaguauuuuaauuuuaauauuuuaauauugagcuauguacagaugcuguaacucagcag

SEQ ID NO: 2247144 - RNA, 77 nt, Homo sapiens
uuuguuaucugguugucugauuacuuacauaauuucaugcggaauuuaagaugguggucagaaaucucaguggcaaa

SEQ ID NO: 2247145 - RNA, 62 nt, Homo sapiens
gcuguaagacuugaauaagucauguaugaaagcaucauaaacuuggcaaaguuuuaaacagc

SEQ ID NO: 2247146 - RNA, 60 nt, Homo sapiens
uugagacaggaucucacucugucacccaggcuggaguacaguggugugaucuuggcucag

SEQ ID NO: 2247147 - RNA, 69 nt, Homo sapiens
uaauguauuaacuaguggaauuugauuucaugcauauuuuuguauagaagucagcuuuuaguuacauug

SEQ ID NO: 2247148 - RNA, 61 nt, Homo sapiens
ugggcauaauuacagcauuguuuuuggaagauuccauguaauaaagucugaagugugcuua

SEQ ID NO: 2247149 - RNA, 55 nt, Homo sapiens
auguagcucuguagguuauuucagaggucugccaacuaugaccugcggguuauau

SEQ ID NO: 2247150 - RNA, 96 nt, Homo sapiens
gacaggagaaucgcuugaaccccggaggcggagguuguggugagccgagaucgcaccauugcacuccagccugggcaacaagagcgaaacuccguc

SEQ ID NO: 2247151 - RNA, 100 nt, Homo sapiens
uuucacagaauauuauacaugcauuugcacgagaguucucuaucagauuuaaaaacuucuuucuccacucuguguguguguguguguguguguuguggag

SEQ ID NO: 2247152 - RNA, 82 nt, Homo sapiens
auuucuuaacugaugaccaauggcuugaaaacuauuguuccauaugcuuuguucagugauugguuauuuuaggcaggcaggu

SEQ ID NO: 2247153 - RNA, 68 nt, Homo sapiens
uuaaaguuguacagauaauuagaggccauggaucaaaugccucauggcccccuguuugugaacauuaa

SEQ ID NO: 2247154 - RNA, 92 nt, Homo sapiens
ccugcucuuccaugcucuccuccaggcacagcagggugcugagguccugagcugcacugagagaagccccaaguacagcaugaagauguagg

SEQ ID NO: 2247155 - RNA, 79 nt, Homo sapiens
acuuccuauugucuuggacuugaaucucauugucuuaauccuuuugaugaauggguuuaaaauuaagaguguaaagagu

SEQ ID NO: 2247156 - RNA, 65 nt, Homo sapiens
ggggucggggcauagccacuuacugacgacuccccacccagcaagugguuuugaacccggacccu

SEQ ID NO: 2247157 - RNA, 74 nt, Homo sapiens
uggugguguguaaauuacuuaucucuaguacagucauaccucagagauauugcagguuuaguuccacaccacca

SEQ ID NO: 2247158 - RNA, 103 nt, Homo sapiens
uauaucuccauaaguugaacugaaaaauaccucuguaaguaaagauucaacccaaggguuaguuuuuacugcgaguuauaaacuucaagaaacuggguaugua

SEQ ID NO: 2247159 - RNA, 68 nt, Homo sapiens
uugcuuucauguagucaucauccugcucaaaaaucuuugaggccaggugcgguggcucaugccuguaa

SEQ ID NO: 2247160 - RNA, 88 nt, Homo sapiens
ggauuacagaccuaaaugugaaacacgaaagucuaaaacucaaaaaauaauauaggagucugggcacagugguucacaccuguaaucc

SEQ ID NO: 2247161 - RNA, 97 nt, Homo sapiens
cuggcccuuccugccauacccagcugcagucaucuucuagaaagcuucccccugcugcuucuggaaaucagcagagggugggcaagggggaagucag

SEQ ID NO: 2247162 - RNA, 129 nt, Homo sapiens
uaaugauauauguuaucuuguuugauuugcguaacauccgaaagcugaguauuaucaguacaauuuguacugagaagacaucagcuuucggaugauuacgcgagucaaacaagauaacauauaucauua

SEQ ID NO: 2247163 - RNA, 73 nt, Homo sapiens
ugggauucacagugaacugguggguuuuucacuuucuuugaagagcccaaaggcauuuacugacaugaucuca

SEQ ID NO: 2247164 - RNA, 75 nt, Homo sapiens
ggagaaggaaagaaaaaguaaagugcauuugauaaauucaaaugcucucuacacguuucugggcacacuuucucu

SEQ ID NO: 2247165 - RNA, 80 nt, Homo sapiens
caugguaacauucaccuguagucccagcugaggcaagaggaucacuugagcccagaaauuugaggcugcagugagccaug

SEQ ID NO: 2247166 - RNA, 71 nt, Homo sapiens
gagcugaauggucuguuuugacagggugcugacuggugcguuuacaaucccugagcuagacacaaagguuc

SEQ ID NO: 2247167 - RNA, 59 nt, Homo sapiens
aacugguauuucccaugaauuuguaugguauaguacaaguaacagggauaauagcaguu

SEQ ID NO: 2247168 - RNA, 59 nt, Homo sapiens
gaauacuguccaagagugauggcaacaauuguguucuaauacuuuuuauggaaguauuc

SEQ ID NO: 2247169 - RNA, 125 nt, Homo sapiens
gagaggaacuaacacuuuuugaggaagacuaauauguccaguguuuugggagcugucaagaucaaagacaacuucccugaccacuggauguaaaaagaucucccucccauaauuguuguccucuc

SEQ ID NO: 2247170 - RNA, 64 nt, Homo sapiens
acaucacuguugguacaaguaaugucaccaguaccauugucaucauuaccaucaacagugaugu

SEQ ID NO: 2247171 - RNA, 89 nt, Homo sapiens
augugaauuuuuuuaggaguuacuuaugguuuauagcaggauagaaacaauuauuguuaugugccaauuaggauuccaaggauucacau

SEQ ID NO: 2247172 - RNA, 96 nt, Homo sapiens
ccucagccucccaaacuguugggauuacagguguaagccaccaugcccaggugagaugcuggcucauuucuaaacccagcucauuggcaagugagg

SEQ ID NO: 2247173 - RNA, 83 nt, Homo sapiens
gaggaauuagcaucagauuccauauucuauauagcagagauuuauaggaugaugggauuugagguuuuaaaucacgaguucuc

SEQ ID NO: 2247174 - RNA, 80 nt, Homo sapiens
uuaaaggacuuaauucuuuuuugaguuucccuuucuacuauucauugaggaugagauaacuacuggauuaaguuuuuuaa

SEQ ID NO: 2247175 - RNA, 76 nt, Homo sapiens
agagacgggauuucuuuauguuacccaggcuggucuugaacuccugucuugaagagauccuccugccucagucucu

SEQ ID NO: 2247176 - RNA, 88 nt, Homo sapiens
cagggaaauacuaacaacacugugauuggcuucuauaaaucuuuuguaaaucuuucacaguugauggucuagauaauuuuuuuuccug

SEQ ID NO: 2247177 - RNA, 76 nt, Homo sapiens
uccuaugacaacacuuugaguauuauuauccucauuucacaggugagaaaaacauagucucagagugguuaaggga

SEQ ID NO: 2247178 - RNA, 57 nt, Homo sapiens
caaggaaaagaaguauuucagaagcauccugcuuuuuaaaugcuagaauuuucuuug

SEQ ID NO: 2247179 - RNA, 92 nt, Homo sapiens
gcaggagaauugcuggaaccugggagguggaggcugcagugagccgagaucacuccauugcacuccagcccaggugacaacagugagacugc

SEQ ID NO: 2247180 - RNA, 60 nt, Homo sapiens
uugcauauuuuaaaguguaaccugagccuucgcgguuucagcuucacuuaaaacaugcaa

SEQ ID NO: 2247181 - RNA, 62 nt, Homo sapiens
uuauggcaaaugaaagaaagccagucucagaaggcgaugggcugggugauucauuuccauaa

SEQ ID NO: 2247182 - RNA, 101 nt, Homo sapiens
ugagauggagucucgcucuguugccuaggcuggaaugcaguggugccaucucggcucacuguaaacuccaccucccagguucaaacgauucuccugccuca

SEQ ID NO: 2247183 - RNA, 58 nt, Homo sapiens
gucucacuucauuuucuuagcccaagcuauagaaaggguugagauuguaugaggagau

SEQ ID NO: 2247184 - RNA, 62 nt, Homo sapiens
cagccuccaggaccagcugugauaguggccgaggcugaccauggcguguggcuuggaggcug

SEQ ID NO: 2247185 - RNA, 55 nt, Homo sapiens
ucuggcuaauuuugguacuuuuuauuagagacaggguuuugcuauguuggccagg

SEQ ID NO: 2247186 - RNA, 69 nt, Homo sapiens
ugacaaccacacugaagaaacagugaaucaguauuuguuuugagcacuguacuuuaucagguacuguca

SEQ ID NO: 2247187 - RNA, 81 nt, Homo sapiens
ucuucagccuugauccucagcaaaggcaaagugccuagcacauaguagguacucagugacugguggaucaauacuauuaga

SEQ ID NO: 2247188 - RNA, 100 nt, Homo sapiens
ugcagccaagagccuggggagagcuggcugcuguccagcccaccggcuggguccugcaguggacagugaaugccacuccucccucccccuaaucacugug

SEQ ID NO: 2247189 - RNA, 65 nt, Homo sapiens
aguucacaugaaguucauaugaagaagacuuaggaguuucaauucaaaggaugcuuuauggaauu

SEQ ID NO: 2247190 - RNA, 61 nt, Homo sapiens
ugaaaugucuuuaggaggcuucuuugaaaguuauuugaugccccuagguaagacuguuuua

SEQ ID NO: 2247191 - RNA, 64 nt, Homo sapiens
gcugggugccacgggcacccugggacccuccuuccguggcccagugguucccuguggccugagu

SEQ ID NO: 2247192 - RNA, 94 nt, Homo sapiens
auuccuuucuugugauaauugaaaucauuucaauucauuuccuucuugguuggacagaaacauguuuucaguagugagcaaaucuugagggaau

SEQ ID NO: 2247193 - RNA, 56 nt, Homo sapiens
gaugaagugcccucuagugacccaacuaagugguggucacuggagcucauuugauu

SEQ ID NO: 2247194 - RNA, 56 nt, Homo sapiens
ccuggcacugagcaguguucuauacacacaguaggagcauaguuaguuaggcuagg

SEQ ID NO: 2247195 - RNA, 89 nt, Homo sapiens
ugcucuugccauaguuuacugagaugaugaguuccaauuucauccaugucccuacaaaggacaugaacucaucauuuuuuauggcugca

SEQ ID NO: 2247196 - RNA, 64 nt, Homo sapiens
gugucagcaauacugacagcauuaguuucauggucacagagauuuuuguuauuauuguuaacau

SEQ ID NO: 2247197 - RNA, 76 nt, Homo sapiens
cagaugauuuucucuuaagugcuuuuuagauaugguuuugucaaaugguaaaauagaauguauuaaagagaaucug

SEQ ID NO: 2247198 - RNA, 70 nt, Homo sapiens
uagggaaguuugagguauuuugucaacuguaaggguuuaccugcauaauuuaucucaaauguauucucua

SEQ ID NO: 2247199 - RNA, 100 nt, Homo sapiens
gaggugagaggauugcuugaucccaggaggucgaggcugcagugagccaugauggcccuacugcacuucagccuugggaaacagaguaagacccugccuc

SEQ ID NO: 2247200 - RNA, 62 nt, Homo sapiens
caguugcacuagccccguuucagguacucaacucagcagccacacguggcuaaguggaacug

SEQ ID NO: 2247201 - RNA, 60 nt, Homo sapiens
uuuucacggugucccagagaguacagaacaaaccucuauucacuggaaacauccggaaaa

SEQ ID NO: 2247202 - RNA, 55 nt, Homo sapiens
acacuucugcaaaucccagacgagaccccaaaauguuaugggauuuuuagggugu

SEQ ID NO: 2247203 - RNA, 61 nt, Homo sapiens
aggccaaaaggaacuuuuugaaggucacaggguuccaucugcaaccuucauuccuuugccu

SEQ ID NO: 2247204 - RNA, 72 nt, Homo sapiens
gcucagugagguagguaccauuaucacugcuagaaagcagugaacuuauauggucuuacuguggcacugggu

SEQ ID NO: 2247205 - RNA, 69 nt, Homo sapiens
ucuuuacagcagugccccacucccauaccaauuuacuguacuggucuguucucacacugcuguuaaaga

SEQ ID NO: 2247206 - RNA, 72 nt, Homo sapiens
uugauuauacuggagguuugagaucugugaucaagaauguuucacagaggagaagaccuuuaacauuuuuag

SEQ ID NO: 2247207 - RNA, 56 nt, Homo sapiens
ccggcuguguggagaggccccugugagaggaacagagguuuccugcccacagccgg

SEQ ID NO: 2247208 - RNA, 63 nt, Homo sapiens
ggaacugaggcuggggacagugaagcuaugcucaaagcucuuguucccuuccacucagucucc

SEQ ID NO: 2247209 - RNA, 69 nt, Homo sapiens
cucacgggauccuuagggugugacuuugcuagccagaaaccucuguggcugguggcaccuuuuccugag

SEQ ID NO: 2247210 - RNA, 80 nt, Homo sapiens
ugcaggaauaaaaagauucauauucugaucaucuugguguugcacgcucugucaugguguuaauuuuccugauuuuugca

SEQ ID NO: 2247211 - RNA, 64 nt, Homo sapiens
ucuauguggaaguggagguggcucuugcuuugcuucagaaaaccaaauccauccaaaucauaga

SEQ ID NO: 2247212 - RNA, 68 nt, Homo sapiens
uggauauauguggucuagaaccuuacuuccccuuuuuucuugggaaugagguuguccacuauaaucca

SEQ ID NO: 2247213 - RNA, 72 nt, Homo sapiens
gagcuagugcaauccuuugaugguaucacuacauucauauuuuucaugguaccagaauucuugcccugguuc

SEQ ID NO: 2247214 - RNA, 57 nt, Homo sapiens
gcuggagccagaagucugaggcugcaaugagcugugaucaugccacugcgcuccagc

SEQ ID NO: 2247215 - RNA, 102 nt, Homo sapiens
gaauuuucuuuugggggauucuauauauucgggauuucaaccaccaaccuaucugguuuuucccgcugaaauguugggugauggaaucaggagagcagauuu

SEQ ID NO: 2247216 - RNA, 65 nt, Homo sapiens
auagagaguuuugagcucaggaguucaacagcaaccugagcaacauuucaaaacuccaucucuau

SEQ ID NO: 2247217 - RNA, 74 nt, Homo sapiens
ggggaaguugugucuugcuggugccugcauucaguuaacucuuuagugcaagaccaucaggaaaugaccucucc

SEQ ID NO: 2247218 - RNA, 83 nt, Homo sapiens
aaggaagauuuguuugaaguaaugaaacugaggacccacgggugacagacuucucaauuugauuacauucauaaauuuuccuu

SEQ ID NO: 2247219 - RNA, 57 nt, Homo sapiens
ugaaagacacagaaguugcccagguuuaguccuaggcagcuuacuuggucucuuuca

SEQ ID NO: 2247220 - RNA, 67 nt, Homo sapiens
ugugaguggaaaacauaugcuuguugaauuaaguaaugaucaauccuaugcucuguuuuuacucaua

SEQ ID NO: 2247221 - RNA, 64 nt, Homo sapiens
ggaagucaggacaacaagacuuguuuaaagcuaccuuuagguaggaaguguuguuuuuacuuuc

SEQ ID NO: 2247222 - RNA, 57 nt, Homo sapiens
uugugcuuguaacuacauucagaagcuaaugggcaaugaaguagucaauaaguauaa

SEQ ID NO: 2247223 - RNA, 71 nt, Homo sapiens
cuauauggugaugguuuucaccugcaugcuugguguaagugugcuaaagagaaccaccuuucauuaaauag

SEQ ID NO: 2247224 - RNA, 72 nt, Homo sapiens
ugcagacuacugugauagagaaugguggagaacguggcagcauuucuccucauccugucgauagcaccugca

SEQ ID NO: 2247225 - RNA, 59 nt, Homo sapiens
aauguggagcaacuagaaucacguacucugcugcugggagugugacuagugcccuuauu

SEQ ID NO: 2247226 - RNA, 75 nt, Homo sapiens
cuugcucuuaaucacuaugccaugaaguacaacagaaucaauauguuggcuuaaaguuaugguggugggaguaag

SEQ ID NO: 2247227 - RNA, 61 nt, Homo sapiens
ccaucuaaagagcagguggauuuccuuugguguaauccucaccuccauuuguaugggaugg

SEQ ID NO: 2247228 - RNA, 68 nt, Homo sapiens
cagaagagagcaagauuguucccauuuucuauuuuucuaguaggaauuaucuucaucuugccuuucug

SEQ ID NO: 2247229 - RNA, 55 nt, Homo sapiens
cugagauggagucucgcauuguugcccaggcuagagugcaguggcgccaucucag

SEQ ID NO: 2247230 - RNA, 87 nt, Homo sapiens
ugucugacuucaacaguuugauugacauacauagguguggaucucuuugaguuuauccuaguugauguuuguuaaauuucuuagaca

SEQ ID NO: 2247231 - RNA, 93 nt, Homo sapiens
gucccagguacuuggguggcugaagugguaggauugcuuuugaggucagggcuucaaugagucaucaucaugccacugcacuccagccugggc

SEQ ID NO: 2247232 - RNA, 62 nt, Homo sapiens
uugcucagauuauuuugaagcaaacaucucccuauuccccugcucagauuauucugaagcaa

SEQ ID NO: 2247233 - RNA, 66 nt, Homo sapiens
ugggaggggcccugaggccugaggugguggaaggagcucaccuaucucaggcccaggcccuugcca

SEQ ID NO: 2247234 - RNA, 99 nt, Homo sapiens
gaggcagaagaaucgcuugaaccggaaaggcggagguugcagugagcugagaucaugccacugcacucuagccuggaugacaaagugagacucugucuc

SEQ ID NO: 2247235 - RNA, 90 nt, Homo sapiens
ggcauuagauucucacaggagcacaaacccuauugugaacugcacacacgagggaucuaaguuuugugcuccuguugagaaucuaaugcc

SEQ ID NO: 2247236 - RNA, 72 nt, Homo sapiens
gucuuacuuagauuugcaacuuagaaaaaucauuuugauuacaauauggaaaauagguugcgagagugagac

SEQ ID NO: 2247237 - RNA, 69 nt, Homo sapiens
ggcugaugacuggagaccucaguagggucuccaugacaaagacucucucugauggaacuuuagccagcc

SEQ ID NO: 2247238 - RNA, 76 nt, Homo sapiens
aucucuauuaagcuuggugugcaagugguacuaaggcauggguuagauagugccucuaacagccaagaauagaggu

SEQ ID NO: 2247239 - RNA, 75 nt, Homo sapiens
ugggauuucuaguucuagacccuugaggaaucaccacacugucuuccacaaugguugaacuaguuuacucuccca

SEQ ID NO: 2247240 - RNA, 63 nt, Homo sapiens
guaagguuguauuucaagaaacaguguauuuaaauuuacuaggcuuuugaaaugcagauuugc

SEQ ID NO: 2247241 - RNA, 79 nt, Homo sapiens
gagauuaacauugugcuucacagaaggaauguggucucaugaaaggauauaugguuuuuggaagcauaucccugauuuc

SEQ ID NO: 2247242 - RNA, 59 nt, Homo sapiens
uauuagguugguggaaaaguaauugaagguuuugccauuacuuuugcaccaaccuagua

SEQ ID NO: 2247243 - RNA, 128 nt, Homo sapiens
ggggagcaugaaggaccaagaagugcuugguauacaguaggcacucaguggcuauccccugggugguaaccaaucauuugcugagucccuauuaugugccgggcaugguaguccuuugcauccuccuc

SEQ ID NO: 2247244 - RNA, 66 nt, Homo sapiens
uuguuaagaugcagauucuggauucacuaggccuaaaacucugccggagcuucugcauuucaacaa

SEQ ID NO: 2247245 - RNA, 97 nt, Homo sapiens
agucauccuuacaucagcugguauuuguuagggaguugucaggugcaacuugcaaaaacaucuugucaaauguccacagcuuuccugugaggugacu

SEQ ID NO: 2247246 - RNA, 121 nt, Homo sapiens
agcugaaaacucuagauccucauuucuucugguuucauugcaguuagaacagaagucugaaaccuagacucaacuguucagugccauuuggccagaacuugagacaggaucuaggaaagcu

SEQ ID NO: 2247247 - RNA, 61 nt, Homo sapiens
guggucccagcacuuacacaucugagccagcucaggcuggauggaaaguuuugagggccac

SEQ ID NO: 2247248 - RNA, 69 nt, Homo sapiens
uuucauuuuuuuaucuauaaauuggguauaguguaaccuauuccaguuuuauggguauagaguuuggaa

SEQ ID NO: 2247249 - RNA, 78 nt, Homo sapiens
ggaaagcugagguaggaggauugcuuaaggccaggaguuugagaccagccugggcaacaucucuacacagaacuuuuu

SEQ ID NO: 2247250 - RNA, 64 nt, Homo sapiens
gcccaguaagaggggaaagaacugagaaagggaugaaugacucuuaaucuucuguuacuguggc

SEQ ID NO: 2247251 - RNA, 62 nt, Homo sapiens
cucugugcagugugauccuuccguauccagaagauacgcagcugaacacaugcagauuagag

SEQ ID NO: 2247252 - RNA, 78 nt, Homo sapiens
ccagcugaaaucugggguuguuuggggaguagcugggagacacgggagacuccccgagagcugcgggugagcugcugg

SEQ ID NO: 2247253 - RNA, 56 nt, Homo sapiens
uugaggacugcuaagcauuugaguaauuuuauaacuaaaugcugagaaguccuuaa

SEQ ID NO: 2247254 - RNA, 57 nt, Homo sapiens
uguaguucagaaguccaggugggcucaaauguguucucugguuaaggcugaacuaua

SEQ ID NO: 2247255 - RNA, 72 nt, Homo sapiens
aaaugugucccagagauauugugucuuuguucucauugguuucaaagaacaucuuuauuucugccuucauuu

SEQ ID NO: 2247256 - RNA, 76 nt, Homo sapiens
cuugauuucaguggugaugcuguccauguccagggagcggcuguuguccauggacagcaccacagauguguucgag

SEQ ID NO: 2247257 - RNA, 83 nt, Homo sapiens
gguguauaccuucccuguguuaugguuucuaauguccagggcggaagaggauauuacucccaauaucgcagggggcguacacc

SEQ ID NO: 2247258 - RNA, 88 nt, Homo sapiens
ggguuacuuugucuauuuuuaaaaucggguuauaaguuuucuuguuauugagcuguaugaguuguuuauaaauuuuggaaguuagccc

SEQ ID NO: 2247259 - RNA, 60 nt, Homo sapiens
ucauuuauugcucaugcauuuaauuucuuaucuaagaaaauggugccaugaccaauguga

SEQ ID NO: 2247260 - RNA, 65 nt, Homo sapiens
aaggcucuuaaguucuacccaagauauacuaaaucauaucucuuggaaugagaccuaagaguuuu

SEQ ID NO: 2247261 - RNA, 80 nt, Homo sapiens
gugugauaaaaaguggauuuuauuugacaacuagcaagaaaaaucuucagugguugcacccagaugaagcuccaaagcac

SEQ ID NO: 2247262 - RNA, 60 nt, Homo sapiens
uuuuucaccugugaacugggacaucaguaaugaugggcucacuagaucaagggagagaaa

SEQ ID NO: 2247263 - RNA, 93 nt, Homo sapiens
gagaacccauuugauauauauauauaaucguguauugauauaaaucuauugauacagguuguguuugugauuagauauuaacuuacuguucuu

SEQ ID NO: 2247264 - RNA, 91 nt, Homo sapiens
gaggcaggagaaucgccugagcugaggaagcugcacugagcuaugauuaugccacugcacuccaggcugggugacagagugagccugucuc

SEQ ID NO: 2247265 - RNA, 80 nt, Homo sapiens
gaaguaaaucuaaggccauugagggagaggcugugaccuugguccugaagcuguuguucucagaggcuuugaaucacuuc

SEQ ID NO: 2247266 - RNA, 82 nt, Homo sapiens
ggcauuaguuagauuuucauaaggagcaugcaaccuagaucccucgugugggcaguucaggcuccugugagaaucuaaugcc

SEQ ID NO: 2247267 - RNA, 83 nt, Homo sapiens
gcugcaugugcuuaaaaaugcagagaacaaugcugaacuucaggguuuagagguagauucuuggaucauugagcacauucagu

SEQ ID NO: 2247268 - RNA, 76 nt, Homo sapiens
uaugucagagagaagauuuggugcucaaaggccgcuguucagauucuuuugucccauggggucuuccuuugaugua

SEQ ID NO: 2247269 - RNA, 62 nt, Homo sapiens
ggguggcuggaucucugcauugucacccucacuccugugccaggcaaaugaagcagccgcuc

SEQ ID NO: 2247270 - RNA, 62 nt, Homo sapiens
gcaguuuuauugguugaaaucuggcacagguaccacuggacuaagacugccaguagggcugu

SEQ ID NO: 2247271 - RNA, 109 nt, Homo sapiens
gguaaggcugaaguaauagaaauaacuagaaaggagacaguugcuguuggaugcuucuuaaaagccuccuguugcacaccgucucucugguucuucugacuuucuugcu

SEQ ID NO: 2247272 - RNA, 72 nt, Homo sapiens
ucaucaaauuuaaggcacuucaugguuucagagaaaacaaaaucugaaaaaaauguguuuuagaauuaauga

SEQ ID NO: 2247273 - RNA, 113 nt, Homo sapiens
agaaacacagcuaauguauaacaguugagugcaugguugcuggagccaguuuggcugaauucaaauuguaacucugucacuuacuaguuuuaugaauuugccuaaguguuuuu

SEQ ID NO: 2247274 - RNA, 63 nt, Homo sapiens
gcugugcuguuugaguauucauagauccagagguauggcuauggccugcuuagaacauacggc

SEQ ID NO: 2247275 - RNA, 71 nt, Homo sapiens
uaucaagacuacuagugcuauggguggcaccaguuuauucaagccucaauauuccacuauuaguccagaug

SEQ ID NO: 2247276 - RNA, 57 nt, Homo sapiens
ugagacgaagucuugcucuguugccaagcuggagugcaguggcacgauuucggcuca

SEQ ID NO: 2247277 - RNA, 56 nt, Homo sapiens
uguuucuuacguuuuuagaggcuucgugacggaguuaucagagacauugagaggca

SEQ ID NO: 2247278 - RNA, 62 nt, Homo sapiens
acuucauagcaaagagcauaaaagucaucagucagugacuagguaugcuauuuauuagaagu

SEQ ID NO: 2247279 - RNA, 66 nt, Homo sapiens
gccuagagcuucaaaguuggcuaggagacaccccaggggugucuuaggaucaauuuuggauugggc

SEQ ID NO: 2247280 - RNA, 55 nt, Homo sapiens
ggcaugauguauuugagguuuguccacauucaacaugugucaauuacuucaugcc

SEQ ID NO: 2247281 - RNA, 56 nt, Homo sapiens
uuucauaaccagcucuagccaguuguagucacagcauggagugcuguguugagaag

SEQ ID NO: 2247282 - RNA, 56 nt, Homo sapiens
ugaggcggugugaugucacaugcuggaauuuucaggauguagaaauacccguuuca

SEQ ID NO: 2247283 - RNA, 66 nt, Homo sapiens
guuuguuauggcucgagcugagcuuuggcugacaguccaccacugcuguuugccgccaucgcagac

SEQ ID NO: 2247284 - RNA, 88 nt, Homo sapiens
cagugcuguucucuggggacaucauuaccauggacccagccauuuguugguuucagugcggugguguuuacacagaacgacuuuacug

SEQ ID NO: 2247285 - RNA, 73 nt, Homo sapiens
guaaauuuucagucuguguguacauuuauagaugaacuauguuuauuguaaucaacacaucauugggaauugc

SEQ ID NO: 2247286 - RNA, 66 nt, Homo sapiens
cuaaaggaaucugagccccugauaucacugagucacuaaaccaaugccaguggccagcuccuuuag

SEQ ID NO: 2247287 - RNA, 69 nt, Homo sapiens
ugucugucuuuugcauauaagucauuuuaacuggggugagaugauaucuuauuguaauuuugauuggca

SEQ ID NO: 2247288 - RNA, 77 nt, Homo sapiens
aucugaaaguuguauugacaagaaagcgucuucuuuuucagccaguuuggcugaauuuuuugucuuuguaacuagau

SEQ ID NO: 2247289 - RNA, 57 nt, Homo sapiens
uguuuguggguuguggcaaaucacugugacuggugauauguaugugaccuagaaaca

SEQ ID NO: 2247290 - RNA, 61 nt, Homo sapiens
ccaaaguggagaguccccacuagcaagaagacuuuugccagaugugcccucuccaccuugg

SEQ ID NO: 2247291 - RNA, 130 nt, Homo sapiens
cuuuauaaauuacccagucucagguaugucuuuauuagcagugugaaaaaagacuaauacacccauuuacuauauuagucuguucucaugcugcuaugaagaaauaccugagacuggguaauguauaaag

SEQ ID NO: 2247292 - RNA, 73 nt, Homo sapiens
aggccuuaaugacaucauaggugaagucauaguugacucuucucuuuccuuccugggaugucauuggcugccu

SEQ ID NO: 2247293 - RNA, 83 nt, Homo sapiens
ucgaaaaacugaaaauagagcuaccauagaauccaguagugggauugcuggauccuacgguagcucuauuuuuaguuuuuuga

SEQ ID NO: 2247294 - RNA, 82 nt, Homo sapiens
gucugcaaggaguuuauaguauaguugaggauggcauuuugacucgagaugaguauuaauacuagcauguucucugaagggc

SEQ ID NO: 2247295 - RNA, 88 nt, Homo sapiens
ggcucaccccacucguuuagguagcuuuggcguuucuuggcuguuggacccaaguagaacagagcuaccuugcccaugggauggagcc

SEQ ID NO: 2247296 - RNA, 88 nt, Homo sapiens
gcagugacccuugcugauaaaccuguggauuuugguaucugugggaggucccagaacaaaucccccaugggcaucaagggaaaacugu

SEQ ID NO: 2247297 - RNA, 57 nt, Homo sapiens
augucuucuuuggagaagugucuguucauauccuucgcccacuuuuugaggaggcau

SEQ ID NO: 2247298 - RNA, 60 nt, Homo sapiens
uucaagagcgcugauaacauguuugaguaggauccuuaaguaacuaucugugcucaugaa

SEQ ID NO: 2247299 - RNA, 63 nt, Homo sapiens
cuggagauuaaccaauugccauugccaaauuauuguaacagcauggaaacuggcuguuuccag

SEQ ID NO: 2247300 - RNA, 101 nt, Homo sapiens
aguuauuuaaggcaaacagcugaaauugcacaaguggugauuugguuaauucugccaguugaguaaguaauugugacacauuucauaguuugcuuaugauu

SEQ ID NO: 2247301 - RNA, 59 nt, Homo sapiens
uuccugaugcaguaagaaugcauagcguugcggacguuaucacgugacuguuucgggag

SEQ ID NO: 2247302 - RNA, 80 nt, Homo sapiens
guagcuauaaaguaaaccuuaauauugaguagauugauuccuuccacuuuauuccucuuuguugagguuauuuuagcuau

SEQ ID NO: 2247303 - RNA, 76 nt, Homo sapiens
guggcauugccuucugcaggaagcccuccccgagcugcaaaacccucuccgcucucacugcacuagguaaugccac

SEQ ID NO: 2247304 - RNA, 65 nt, Homo sapiens
guuuagcuuauaucugcagugugaccccagucagguuccaccuauauuugcaauuuaagcuagau

SEQ ID NO: 2247305 - RNA, 95 nt, Homo sapiens
caaugcagucucuuuuuugguuccauaugaacuuucaaguaguuuuuuccaauucugugaagaaagucauugguagcuugauggggauggcauug

SEQ ID NO: 2247306 - RNA, 90 nt, Homo sapiens
gcagaccuccuauuauucugucuuuggucucaaucaaggagaagaugccguugagaagccucaaagaaggaagcagaaaggagaauuugu

SEQ ID NO: 2247307 - RNA, 62 nt, Homo sapiens
uuguuacccuggaguaguaggaaucuggguucuagcuuccugacaaccacuaggaauuacag

SEQ ID NO: 2247308 - RNA, 107 nt, Homo sapiens
auaucuaugaauuuccuguaaaguuuucucccuuccugccuucaucuucauauagauauagaugaaggcaggagggagaaaagugacagguaaaaauucagacauau

SEQ ID NO: 2247309 - RNA, 68 nt, Homo sapiens
uguauuaaggcccauucuaugaagcaguaauugagaaaugauugguuacacagacuggugcuuauaca

SEQ ID NO: 2247310 - RNA, 94 nt, Homo sapiens
gccaaaugcuuugcuagagcugguaaaauggaaccaaaucgacuguccaauggauuugguccccuucaaccagcuguagcugugcauugauggc

SEQ ID NO: 2247311 - RNA, 95 nt, Homo sapiens
aggagacccaaagcaaguagcuccuuucugcaggcaggucaucccaacaaguguccagcucucaguagagaggagaccuguaguggguagcuccu

SEQ ID NO: 2247312 - RNA, 64 nt, Homo sapiens
auccuagauuuuuucagaagugguaaaaguacuaaauuauaucacacuggaagaaguuaaggau

SEQ ID NO: 2247313 - RNA, 87 nt, Homo sapiens
ggagaauugcuugaacccggcaggcggaguugcagugagucgagauugugcuacugcacuccagccuugccaacagagugagacucc

SEQ ID NO: 2247314 - RNA, 87 nt, Homo sapiens
ggagaaucgcuugaacucggaggcagagguugcagugagccgagaucgcaccacugcacuccagccugugagacagagcgagacucu

SEQ ID NO: 2247315 - RNA, 125 nt, Homo sapiens
uauggaugcauacagccaugugcauguacagcugugugugcauauagccaugugugcguacaaccaugugugcauauggcuaugugagcauaccaccacacaagcaccaugugugugcaaccaug

SEQ ID NO: 2247316 - RNA, 89 nt, Homo sapiens
uauacguguguaucacauguguguaaauauauacacacguguauacacacauguguguaaauauauacacacguguuuacacacgugua

SEQ ID NO: 2247317 - RNA, 63 nt, Homo sapiens
uguuacagcagcacaaaauggaccaaggcaaauauugguacccagaauguggcugcuguaaca

SEQ ID NO: 2247318 - RNA, 74 nt, Homo sapiens
cauugugugcaaauguguaccuacaugugugugaauguccaugugcauuguguggaguacauuugcacugagug

SEQ ID NO: 2247319 - RNA, 62 nt, Homo sapiens
gcuagaguaguuucuauauucuucagccgaaaucugguuaagagcauauagacuuuuuuagc

SEQ ID NO: 2247320 - RNA, 57 nt, Homo sapiens
gggggccugaccugugguaagugaaaaaugucacuuuaugacaggcucaggagcccc

SEQ ID NO: 2247321 - RNA, 66 nt, Homo sapiens
ucgcacaucaaaugcuggcagagugccuggugcuuaguaggugcuuagugaguguuuguugaguga

SEQ ID NO: 2247322 - RNA, 81 nt, Homo sapiens
gccauggaggacuuucuuggcaaggcuacuuaaaauagcagucccucaaauuuguuacuuugcacuugcuccuucuauggc

SEQ ID NO: 2247323 - RNA, 87 nt, Homo sapiens
cugcuuucacuccacuaucagcuuaucuguacccacucaggcugagugagugucaggagacagguagcuguugcguaggggagacag

SEQ ID NO: 2247324 - RNA, 95 nt, Homo sapiens
agaugcugcuuuaaguuguuuugagaugugguucaaggguguuuguugaucaaacaccaagagcuagcuauuaccaagaauaauaacuagcauuu

SEQ ID NO: 2247325 - RNA, 63 nt, Homo sapiens
gcuaucugguguuuuucucccucgucguuguaaucaggcaugauugaaaaagcacuagguagc

SEQ ID NO: 2247326 - RNA, 63 nt, Homo sapiens
gaacuauggauguucuagggaugugaugauggaaaauauuacaaaugcccauacaucuaguuc

SEQ ID NO: 2247327 - RNA, 66 nt, Homo sapiens
agaugggcauaucacuugaggucaggaguuggagaccagccuggccaacauggugaaucuccgucu

SEQ ID NO: 2247328 - RNA, 112 nt, Homo sapiens
guguuaugcuggguaagguuuggcaaauagguuuuauugcauugccaauuuuguuugauuggagauuugcuuugagggcuguguugcagaugacucuguauccguguaauac

SEQ ID NO: 2247329 - RNA, 56 nt, Homo sapiens
guggaauugcuggaucaaaugguaguucuaccuuuagaucuuuaaggaaucuccac

SEQ ID NO: 2247330 - RNA, 66 nt, Homo sapiens
gccccuccuucuagagaggugagcuggagaaggucauuuucucaguuccuacuuuggugaaggggu

SEQ ID NO: 2247331 - RNA, 71 nt, Homo sapiens
gguagaggugggagucuugcuauguugcccaucucaaacuccugggcucaaguaauccucccgccuuggcc

SEQ ID NO: 2247332 - RNA, 130 nt, Homo sapiens
ugaggguugucaaggacacucaggcaggauuugacccaaaagagaugaagguccugacuguacuccaguauggcugcagcauaaucagauuuuccucucucucugucacugucucagaaagcagccuuca

SEQ ID NO: 2247333 - RNA, 113 nt, Homo sapiens
aauguggaauucaccauucguuuggcauuuuacuacucaaauuuauuccauacaaaaaaaucagaggcaaaauauuugagucguggaauacuaaaugaguggagugacacauu

SEQ ID NO: 2247334 - RNA, 75 nt, Homo sapiens
ggggcccgcccugugcuaggguuuucagcaggagugaaugagcugcugugagacugacagggcagggugugcucc

SEQ ID NO: 2247335 - RNA, 59 nt, Homo sapiens
ucuagccagcaauuuguggugcucuaacaugcaauauauauaacaaauugccagcuagg

SEQ ID NO: 2247336 - RNA, 73 nt, Homo sapiens
agaagcuaaauaaugcuguggucuaauggggagucacauuuccugguuuccgccacagucuuuuuuugcuuuu

SEQ ID NO: 2247337 - RNA, 87 nt, Homo sapiens
gaguugggagaccguugguuaccuucagaaaugaguugcgacaguuagugccgcuugcugaacaggaaccuggcagucuccagauuu

SEQ ID NO: 2247338 - RNA, 61 nt, Homo sapiens
acccaggaggcagagguugcagugagccaagaucacgccacugcacuccagccuccugggu

SEQ ID NO: 2247339 - RNA, 107 nt, Homo sapiens
uuuggagacaagagucuugcucuguucccgggguggaaugcagugaugugaucacagcucccugcaguuucuaccuccugggcucaagcuauccuccugccuccaga

SEQ ID NO: 2247340 - RNA, 87 nt, Homo sapiens
ggcaaaggggucaacuuggaaaaggucaacuccccaaaaaauguaccuucucaaacugucagguugaccagauguccuuccuuugcc

SEQ ID NO: 2247341 - RNA, 66 nt, Homo sapiens
augaaucaacagugauggaaaguuauacugaaucauuucauaucuguuuugauuacugugaauuau

SEQ ID NO: 2247342 - RNA, 65 nt, Homo sapiens
ccucucuugcagcaaauaggaaugaggaagccaaugcuagcuuccucuugugacuguaagacagg

SEQ ID NO: 2247343 - RNA, 88 nt, Homo sapiens
ggagaaucacuugaacccaggaggcgcagguugcggugagccgaggucaugccauugcacuccauccugggcaauagagugagacucc

SEQ ID NO: 2247344 - RNA, 73 nt, Homo sapiens
cugcacauuucagcuugaaugcuccgguguggggcuugcaccugaucaccagaugcuucaagcagauggccag

SEQ ID NO: 2247345 - RNA, 69 nt, Homo sapiens
ggguggacuugucaugguuaauuuuauguaucuacuuuacuuggucauaaggugcccagauauuuacuc

SEQ ID NO: 2247346 - RNA, 105 nt, Homo sapiens
ucuugcacagcauuuaguacagugcuugguaucuaguaagcucucaauagacauugcuaccauugauaccagcacugccucuacuaauaauucugcuacaaaaga

SEQ ID NO: 2247347 - RNA, 56 nt, Homo sapiens
ggguaugugcccuuaaugacaugcacaaagucacuuuugcauaggguuacauacuc

SEQ ID NO: 2247348 - RNA, 66 nt, Homo sapiens
cugaggucauucaugugggcgcauaacagaagugacagacugguguguuggcaagaaugaucacag

SEQ ID NO: 2247349 - RNA, 85 nt, Homo sapiens
aguuucgugaauguuuuggucuuucacagcaggccuuucuuuuucccugaugaugaaacacauccaaugcagaauucauagaacu

SEQ ID NO: 2247350 - RNA, 62 nt, Homo sapiens
ggucuuugguucuguuuauguaauggauuacguuuauugauuugcauauguugaaccagacu

SEQ ID NO: 2247351 - RNA, 59 nt, Homo sapiens
uauggcuaagaaaguguggcagugggcucauucucauggaauucacuggucuuaccaug

SEQ ID NO: 2247352 - RNA, 61 nt, Homo sapiens
cuauguccauauguucucaucauuuagcucccacuuauaagugggaacaugugguauaugg

SEQ ID NO: 2247353 - RNA, 77 nt, Homo sapiens
uugcucuguugccuaggcuggagugcaguggcaugaucucagcucacugcaaccuccaccucccagguucuaaguaa

SEQ ID NO: 2247354 - RNA, 67 nt, Homo sapiens
cugagcccagaaguuagaggcugcaaugagccaugauagugccauugcacucuagucugggugacag

SEQ ID NO: 2247355 - RNA, 77 nt, Homo sapiens
guuggcugucuaugagccaggaagccagcccucaccagacacaaaucugcuggcucccugaucuuggacuucccagc

SEQ ID NO: 2247356 - RNA, 72 nt, Homo sapiens
gcugcuaucacucuuaggguuggagggacaaaagaaagcguucccagagccugggagugagggccaccuggu

SEQ ID NO: 2247357 - RNA, 83 nt, Homo sapiens
uggcuuucaauauguccagauaauuucccuuuauuuguaguuuguuaagagguuuuaucauggaaagauguugaaauuuguca

SEQ ID NO: 2247358 - RNA, 70 nt, Homo sapiens
ucaagaaguuugcugucuguagccaaaggacucagaaaugagcagucuggcgagacagaaaacuuuuaga

SEQ ID NO: 2247359 - RNA, 71 nt, Homo sapiens
ccuuugacauguccaggugguccuguuguuggcaucccuggcugcacuggaccccaggauauggaaaaagg

SEQ ID NO: 2247360 - RNA, 55 nt, Homo sapiens
gggaagagguagagcugggcuuuggacccaggagccugguuucccugcuucuccc

SEQ ID NO: 2247361 - RNA, 76 nt, Homo sapiens
cugagguaauuuuccagauaauccccaccccaaaucggguaaugccuggccugauugaucaggacaguugccucag

SEQ ID NO: 2247362 - RNA, 60 nt, Homo sapiens
ugugaauagugcugcaauaaacauaugugugcaugugucuuuauagcagcaugauuuaua

SEQ ID NO: 2247363 - RNA, 116 nt, Homo sapiens
gacugugggaaaaaugcaguauuugggugggagugucccguuuuuccagguacagucugucacggcuucccuuggcuaggaaagggaaauucccugaccccuugcacuucccaguu

SEQ ID NO: 2247364 - RNA, 129 nt, Homo sapiens
gagaagggauucuugauaauagaguacuaggugauuuuuggcauguaaugcagaaguugcaagaagugguaacaaugaugcaauuguuuuaccugccauuuauuuacuuuuaugugagccauucuucuu

SEQ ID NO: 2247365 - RNA, 76 nt, Homo sapiens
uggcuauaauauuuggccauaauuuuaauuggccauuaaauuuggccaaguaauauggccaaauaauaauuagcca

SEQ ID NO: 2247366 - RNA, 93 nt, Homo sapiens
aguguaucuggacaacuuacucagcaucugaguauucacagugguaagaaacccuuugaaugcaacaaaugcgggaagucuuuuagguucauu

SEQ ID NO: 2247367 - RNA, 59 nt, Homo sapiens
ugagauuaucguaauguaucuccagcccccauuuguggaugucauuuaugaagaucuca

SEQ ID NO: 2247368 - RNA, 85 nt, Homo sapiens
cuuaaggugucuacuaguacugucugguuaccugacaguacugcagcugucagguaugcaacagaaugcaacugaauuccuuggg

SEQ ID NO: 2247369 - RNA, 86 nt, Homo sapiens
ggagaaucacucaaucccaggcggcacagguugcagugagccgagacugcagcauugcacuccagccugggcgacagcgagacucc

SEQ ID NO: 2247370 - RNA, 63 nt, Homo sapiens
agugcaaagccgagguuucuugggccucucacaucagcaccucccagaccucgguucuguauu

SEQ ID NO: 2247371 - RNA, 58 nt, Homo sapiens
cugucacagcuggcauugucugcagcuuuuccaagugugcagugcaaguuguuggugg

SEQ ID NO: 2247372 - RNA, 98 nt, Homo sapiens
gugauaaagagucaugagcaaaaguauguauugguuagcaucugggggcagcuggguuuuuuggcuaucuguacuuuauguucacggcucugugucac

SEQ ID NO: 2247373 - RNA, 63 nt, Homo sapiens
ccuuuuucucucauugcaggcagcaucugaagcagacguagaaacugcacugagaaaaggagg

SEQ ID NO: 2247374 - RNA, 93 nt, Homo sapiens
cagaaacccaguuuucagucauucacauggaggugauaguugaaguuguauaugcuucagcauucaugcuucaugaagaugcugaaguuucug

SEQ ID NO: 2247375 - RNA, 56 nt, Homo sapiens
gguauauaguggcuuuccauugagguuuucacucuuugaaggaggucauuuauacc

SEQ ID NO: 2247376 - RNA, 105 nt, Homo sapiens
auccauuuauauaaaaaauguuuucgcaccucucuuggauguggaugggugcccagggguaacacuuucuagacaagggaauaaguguggacacagacauuggau

SEQ ID NO: 2247377 - RNA, 86 nt, Homo sapiens
auauuagguuggugaccauguaauugugauuuuucccauugaaaguaauggcaaaaaaugcaauuacuuuugcaccacccuaauau

SEQ ID NO: 2247378 - RNA, 64 nt, Homo sapiens
aggacaggagaacagcgcaaagacuugaagcaaagguaaaguuauugcuuuacucucuuauccu

SEQ ID NO: 2247379 - RNA, 129 nt, Homo sapiens
cacuucagccuucugacuagcugggacuacaggcauguaucacuacaccuggcuaauuaaaaacgauuuuuugaaggccgggcaugguggcucacgccuguaaucccagcacuuugggaggccgaggug

SEQ ID NO: 2247380 - RNA, 129 nt, Homo sapiens
ucccgagagaacucccacaggugaggccccggcugggcggggguggcagagguggccucuggucccagcaucacuuggccgcagccuucucucugccuaggcucuuccugcuggugcaagcuuuugggg

SEQ ID NO: 2247381 - RNA, 66 nt, Homo sapiens
ucugcuggucuagacagaaaucauuuuuaaaaaaucaauauaaaaaugcucucaggugccaguaga

SEQ ID NO: 2247382 - RNA, 75 nt, Homo sapiens
caugccacuguggacaaagacagaugcgaucguguguguguggggacugcguauauguuuuugucagugugugug

SEQ ID NO: 2247383 - RNA, 57 nt, Homo sapiens
auguauggaguuuaggggaugggcacacucagagcccauacccccuuccccaaacau

SEQ ID NO: 2247384 - RNA, 79 nt, Homo sapiens
gucagaugguggauuauuucgauuccugauuaaaaucuuuacagcuccucaauaucuauggaauagucuacacucugac

SEQ ID NO: 2247385 - RNA, 71 nt, Homo sapiens
aguaugcagauuccauaguugcacucuggagccagaccaccuggguuccgauuccagcuaugacacauacu

SEQ ID NO: 2247386 - RNA, 56 nt, Homo sapiens
uuaagacaccaaucauuggauuuagggcaaccuaauccauggugaccuugucuuaa

SEQ ID NO: 2247387 - RNA, 65 nt, Homo sapiens
uaucauagcgggcccacaccucuaaguugaugcuaacaaggugacucagagugggccccuagaua

SEQ ID NO: 2247388 - RNA, 58 nt, Homo sapiens
uaguggaacugugucauacaaaugcagccuguuguauugaauguacuuguucucacua

SEQ ID NO: 2247389 - RNA, 63 nt, Homo sapiens
caugagcacccuuuguugauugcaauaagauccagguuuugggagaggcaaggggaugccaug

SEQ ID NO: 2247390 - RNA, 67 nt, Homo sapiens
gauaguggaguguaaagcgucuuuuucagacaguuuucugcaggaguggcuauuaagcugcaguguu

SEQ ID NO: 2247391 - RNA, 89 nt, Homo sapiens
ggccugggauaccaggucuggggaucucagggacucuuagcacuuuaagacacauguguucccaggcccugguguguuccucuagugcc

SEQ ID NO: 2247392 - RNA, 84 nt, Homo sapiens
agcuuguguguaaacaggaaauaucaguguaaaacagaaaauaaaauauguaauuaaugcuguggucugguuuaaauacaaguu

SEQ ID NO: 2247393 - RNA, 118 nt, Homo sapiens
aauucccuauccaucuuccuacacacuuucauagccuuugucgucugagggaaaaagaaagguuuucaucaugccaguuaaaggcugugaaugugaccuagauaauucuuggggaauu

SEQ ID NO: 2247394 - RNA, 56 nt, Homo sapiens
uugagauggagucucacucuuguuaccuaggcuagagugcaauggcaccaucucag

SEQ ID NO: 2247395 - RNA, 90 nt, Homo sapiens
ugguucucaccuggagguccucguguaguacagucugauauugggugaagcugaggcuguagucauuugaaggauguccaaguugugcca

SEQ ID NO: 2247396 - RNA, 63 nt, Homo sapiens
aacuuacagucuagaggagaaucaggcuaacaaggagucacucaccauagacugugaaaaguu

SEQ ID NO: 2247397 - RNA, 130 nt, Homo sapiens
gauucucuggagggaguacucucagaccucagcaaauuguccuauugguuuaagccauaaguuagcucaugcugguaccaagcaccgauaggagauuugucaaaggucaggggcaccuccacucaggauc

SEQ ID NO: 2247398 - RNA, 67 nt, Homo sapiens
agagauuauccuggcuucucugugugcacuaaaucuaaucugagcccugaaaagcaggauauuuucu

SEQ ID NO: 2247399 - RNA, 58 nt, Homo sapiens
uucucagugaaauaaauuauuuuuggccaacuugcuaaagugaaauuuuuacugggga

SEQ ID NO: 2247400 - RNA, 73 nt, Homo sapiens
uccaguuugacaugauuaauuaccuaagugcagcaagaauaaugauugacuacauaaguaaucucaaauugga

SEQ ID NO: 2247401 - RNA, 58 nt, Homo sapiens
acauucugagaaaugugucauuaggugauuuuguccuugugugaacaucacagagugu

SEQ ID NO: 2247402 - RNA, 125 nt, Homo sapiens
ucaguaucuaaucaaauggggagcaaauuacucaucuauggcucugucuuuuaaguuguuuaggagaauaaugaacuuuuagauagaguauagguaggaaauacugaaagcccugaaaauauuga

SEQ ID NO: 2247403 - RNA, 89 nt, Homo sapiens
uacugauaugcaggaugugguauucacucugugcagcuuaaugggauaucugacagaugacugccacuguagaagcaugaucuucagug

SEQ ID NO: 2247404 - RNA, 88 nt, Homo sapiens
ggaggauugcuugaccccaggaguuggagguugcagugaacuaugauaauaccauugcacucuagucugggugacagagcaagacucu

SEQ ID NO: 2247405 - RNA, 72 nt, Homo sapiens
aggauucuccucuuuucucaguugcauaagcaaauccuuaugcaaacaucugaagagacaucagagaaucuu

SEQ ID NO: 2247406 - RNA, 77 nt, Homo sapiens
cuucgguacuuagucaaucuugcauuuguuagccagugaugucccuugguguuuauuaagguuacuacaguaugagg

SEQ ID NO: 2247407 - RNA, 68 nt, Homo sapiens
ggguacacgugcacaacgugcacguuuguuacauauguauacaugugccauguugguaugcugcaccc

SEQ ID NO: 2247408 - RNA, 82 nt, Homo sapiens
cuugugccacauuugauagucauucaauuuagccaguuuaucuuaaagucugcaauuugaggauugucauaauuuguauaag

SEQ ID NO: 2247409 - RNA, 87 nt, Homo sapiens
cacagaggggaagagcauuggauggggagauuugaguuggaaggucagauccucaaaggucuacucauuggagucuccacaucugug

SEQ ID NO: 2247410 - RNA, 70 nt, Homo sapiens
gucacuagaaccuggaagacagagguugcagugagcugagauugcaccacuguacuccagucugggugac

SEQ ID NO: 2247411 - RNA, 57 nt, Homo sapiens
ccuggauucaaaauggcaugauucuuuuagaaccgagucauacuguggaguaccagg

SEQ ID NO: 2247412 - RNA, 96 nt, Homo sapiens
acuugaguacuuacagcauaucagcaucaaaacacaggcuguuuccaugucauaaaaaugauuugugcuuuugagcugagaugagugaagucaagu

SEQ ID NO: 2247413 - RNA, 88 nt, Homo sapiens
aaucugagauugucaugauuacauuguuuugggguuaaaguguccaaucaucucccaccauaaaaugauggugacaauaauucagguu

SEQ ID NO: 2247414 - RNA, 58 nt, Homo sapiens
ggcuguuagcccagcaauugggcgugacuguuccugcccagugugcugggugacagcu

SEQ ID NO: 2247415 - RNA, 73 nt, Homo sapiens
gggagggcauuuucuggguuaucagggguuaaaggguugccagucuugacagcugaggcccagaguacccccc

SEQ ID NO: 2247416 - RNA, 129 nt, Homo sapiens
cuaagacgacugaaguuuacucaaaauguaccaauguccaguauugaacacaaugaaaggguugccagugccuuugucauugccaguacuucuuuugcugguauuuuagagcuacuuacacugagaaug

SEQ ID NO: 2247417 - RNA, 127 nt, Homo sapiens
aaaauacaaguuguccagugaaauuugaauuucaggugaucagcgaauaauauuuuaguauaaguaugucccaaauauugcaugguuuuuaucugaaauucagauuucauuggauuuccugcauuuu

SEQ ID NO: 2247418 - RNA, 61 nt, Homo sapiens
gugauacuaaauguguaaucauagaauacagauaauuuaaagugaauacauuugguuucau

SEQ ID NO: 2247419 - RNA, 55 nt, Homo sapiens
uuagauacccuuuaguauaaaaucagaguccauaggcucugagaggauuaucuga

SEQ ID NO: 2247420 - RNA, 57 nt, Homo sapiens
caagugacugagccgccucggcugguugcuguugccugggguccugcuugucacuug

SEQ ID NO: 2247421 - RNA, 64 nt, Homo sapiens
agcuaaagccaugcuuagugaaaaauguauacuucaaaugcauauuuuauaaagauggaaagcu

SEQ ID NO: 2247422 - RNA, 129 nt, Homo sapiens
guaugaaaauaguggucccaucuaguaauauaguaguaaucucaaguuauuuaaauaugaaagugaccuggaaugaagcuuauauugccuuucuguagauggugacagcuaccauuuauaguacagucc

SEQ ID NO: 2247423 - RNA, 57 nt, Homo sapiens
guuacaggcuggagugcagugaaugagaucgugccacuguacuacagccugggugac

SEQ ID NO: 2247424 - RNA, 64 nt, Homo sapiens
ugggcaagugacuuggcuucucuguauugccucaucuguaaaaugaagcuaguacuugaaccua

SEQ ID NO: 2247425 - RNA, 73 nt, Homo sapiens
uuacccaaaugccacuguuuaugucacuuaauguugagugcuuucauuaagauauugagugguaauuugguag

SEQ ID NO: 2247426 - RNA, 82 nt, Homo sapiens
caguggcaucaucacaacucaaugcugcaaccugaagacccacccuuuugagguggguuuucaguauugaaugauggcgcug

SEQ ID NO: 2247427 - RNA, 67 nt, Homo sapiens
accuaaggaugguuuuuuaagaagagccucaggugcuggugugggucuuugaaagcacaucaaaggu

SEQ ID NO: 2247428 - RNA, 93 nt, Homo sapiens
ggcauguucagaagugcuguaugggagccuaggacuaaagucaaaaaccuuagcuguucaccugguauucuauaguacuccaucugagcuguc

SEQ ID NO: 2247429 - RNA, 87 nt, Homo sapiens
aaauuuaaggaggcaccuacucccagggucaugcaaaagccaacuuugcauuugcacaauccugugagugagucccuccuuaaauuu

SEQ ID NO: 2247430 - RNA, 74 nt, Homo sapiens
uuucuuuguaucuuuguuaguuuauucuuugcuugaaaggaaguaaguaguguugagacaaguuuauaaggaaa

SEQ ID NO: 2247431 - RNA, 66 nt, Homo sapiens
caguuugguuuuccaucauuugacacaagcggacuucuuaauucugucacugguggacgaucacug

SEQ ID NO: 2247432 - RNA, 103 nt, Homo sapiens
gcucugucuccucugauugccccuaauggagcuugacaguuguagaguuaauccaagcucuggucuccagguuucaccucaggaaacaaucgguccccagagc

SEQ ID NO: 2247433 - RNA, 77 nt, Homo sapiens
uugucaugaaauauguuuuucuaucccuucauuuucagucuaugggugucuucauggguaaaauguguuucugauag

SEQ ID NO: 2247434 - RNA, 97 nt, Homo sapiens
gaggcaggagaauugcuugaacccggguuggagguugcagugagcugagauggcgccauuguacuccagccugggcuaaagagcaagagucuguuuc

SEQ ID NO: 2247435 - RNA, 58 nt, Homo sapiens
ugccuuaauuuuuuauaaucucuguugaccuccaaaagagaccuguaaaguucaggca

SEQ ID NO: 2247436 - RNA, 129 nt, Homo sapiens
ccagugccuaacaauagaggcaaacccgugagcagaaagcugcaaggucgugugcucagcaggaggugaggcugggguggcugagcagcgucuguucagugcuacuuuccucugagacggguccacugg

SEQ ID NO: 2247437 - RNA, 86 nt, Homo sapiens
aggaauaaguguguguguguguguguguguguguguguguguguguacaccaguacuuuauacaagcacauagcaaaaaaauuccu

SEQ ID NO: 2247438 - RNA, 57 nt, Homo sapiens
ucuggcucauagguugaacuagauaccacauggguaucucauuacugaugagccaga

SEQ ID NO: 2247439 - RNA, 64 nt, Homo sapiens
aggccaguuuuuggagggaaacaucaauacuguugccauucaguucucuaugccaugcuggccu

SEQ ID NO: 2247440 - RNA, 100 nt, Homo sapiens
ucugcugaagcaacggcccaagcuguaccuuggccccuuucauccacagcuggagcagcugggaugcagggugccaugccuugaggcugcacagagcaga

SEQ ID NO: 2247441 - RNA, 58 nt, Homo sapiens
ugagaucgagucucgcucugucgcccaggcuggagugcaguggcgugaucucgacuca

SEQ ID NO: 2247442 - RNA, 71 nt, Homo sapiens
ugggagguauggucuuugagaggugacugagucaugaggacucuucuuucaagaauggauuaggucucuua

SEQ ID NO: 2247443 - RNA, 80 nt, Homo sapiens
gugcguuauuagagcaaguuuucugacauauaaaccuggucccauauuauuuaucuguuuaaaacuguucagugauguac

SEQ ID NO: 2247444 - RNA, 72 nt, Homo sapiens
auaauuccuaauaacggagcuaccuuucuccaguugucucauccugagugaaggggcucuguugugauuuau

SEQ ID NO: 2247445 - RNA, 65 nt, Homo sapiens
cuggcauggggcuuuccaagcuuaauuagcucauguuuguaaaguucuuaggaagcucaggccag

SEQ ID NO: 2247446 - RNA, 72 nt, Homo sapiens
ccagcgaugaggccaacacuaucccgcuagcuuucuaaggaaaucugguguauuggugcugggucaugcugg

SEQ ID NO: 2247447 - RNA, 106 nt, Homo sapiens
ucccacacgcggacagagaccacuagugagguccagagcaucacauguggaugccauccacaguugaaauuuugacugucauacguggaucuggccacagguggga

SEQ ID NO: 2247448 - RNA, 59 nt, Homo sapiens
ugaagugaaugguaaguaugccaaagaugcuucuacaggauacugaucaucacucuuca

SEQ ID NO: 2247449 - RNA, 55 nt, Homo sapiens
uaugaaagcuacuucucacaaucacagacuuuuggugugagaaggaucuuauaug

SEQ ID NO: 2247450 - RNA, 97 nt, Homo sapiens
cacaggccaaagaaacaggccccagauggagucccguggaguucugccaucucuuuggcugagcugaauugcugccauuugccugcaucugucagug

SEQ ID NO: 2247451 - RNA, 67 nt, Homo sapiens
auuuuugguugguaggcuauuaauuauugccucaauuucagagccuguuaauggucuacucagggau

SEQ ID NO: 2247452 - RNA, 83 nt, Homo sapiens
gccaguuuucccagcauaauuuauuaaauaagguaauauuuuuguaugcuuuguugaaaaucauuuggguguaugcaccuggc

SEQ ID NO: 2247453 - RNA, 119 nt, Homo sapiens
uguguacacagguaucugugucuguguauaugugucuguguguaugucuuauguguacaugugucugcauguauauguuuguacauaugucucuguauauauaugugucuguguacaca

SEQ ID NO: 2247454 - RNA, 59 nt, Homo sapiens
gaaauuuacaacuuucucaugggaagaaagagaaaauccuaugaguuaggggaaauuuc

SEQ ID NO: 2247455 - RNA, 117 nt, Homo sapiens
uaucugcagcaggaacauguccuuaaggcacugaucgcucaugcuauuguuuguggcuuaggaacaccuugcgugggcgucaauggccaucaggaacaugucacagugcugcagaua

SEQ ID NO: 2247456 - RNA, 121 nt, Homo sapiens
uuggcuuccuuuugcuuguguuacaagaggaccuuugggggcauauuagcuugcuuguuaagaccaaugaguaaaucacuaauggcuuccggccacuuugcauacauccaagaauaguuga

SEQ ID NO: 2247457 - RNA, 92 nt, Homo sapiens
augggaacuacaauucaagaugacauuuggguggggacaaagccaaaccauaucuuuccagccuuggccccucccaaauuucauguccucau

SEQ ID NO: 2247458 - RNA, 80 nt, Homo sapiens
uuggaguacagguaguauuugguuacauaaguaaguucuucaguggugauuugugagauuuuggugcaccuguaacccga

SEQ ID NO: 2247459 - RNA, 59 nt, Homo sapiens
guggugcauccuugaguaagcuucauaauucaugugcaaagcuugguuuggaugaucac

SEQ ID NO: 2247460 - RNA, 71 nt, Homo sapiens
uguuuagaacuuuaaaguguuuucaaaaugucagaaucucuggacauaugauaaugcuuuucuucagagca

SEQ ID NO: 2247461 - RNA, 66 nt, Homo sapiens
augcaagaaauaucucuuuuucucugacguucuccuuuagugguagucaaaagagauuucuggcau

SEQ ID NO: 2247462 - RNA, 128 nt, Homo sapiens
guagagaugggguuucaccauguuggucaggcuggucuugaacuccugaccucaggugaggagggcagaucacuugaggucagagguucgagaccagccugggcaacauggugaaacccugucucuac

SEQ ID NO: 2247463 - RNA, 70 nt, Homo sapiens
ucucugugacuggagcuguaugugguuacauguggucacaagugcacauucaaguucacauacacagaga

SEQ ID NO: 2247464 - RNA, 55 nt, Homo sapiens
aaugaucaauguuugaggugauggauauccaucccaauuacccuauuugaucguu

SEQ ID NO: 2247465 - RNA, 62 nt, Homo sapiens
gaggcgggcggaucacgaguucaggagaucgagaccauccuaacacggugaaaucccgucuc

SEQ ID NO: 2247466 - RNA, 56 nt, Homo sapiens
uuggucaucucccuccuuuuagcuuaaaccgaagcaugaugggggagauaggccga

SEQ ID NO: 2247467 - RNA, 110 nt, Homo sapiens
auucauguggccccuggacuaacuggaucgauuccaaauguagaucuuccaaaugaaacugaagacauugaauugaauccagauuuuacaggggaauagcuaaaaugaau

SEQ ID NO: 2247468 - RNA, 65 nt, Homo sapiens
aacucuauacuuuugggugucgcugcuauaaucuaguucuccuuauugcagauacccaggaaguu

SEQ ID NO: 2247469 - RNA, 58 nt, Homo sapiens
uugauauuaaguacugaagugggagaguucccugaccccuucacaggacuugugucag

SEQ ID NO: 2247470 - RNA, 57 nt, Homo sapiens
ugaaguccuaacuuccaguacaucagaaugugacuguacuuagagauagggucuuua

SEQ ID NO: 2247471 - RNA, 72 nt, Homo sapiens
cagguggaggucauuggaucaugggggugguuucucccaugcuguucucaugauagugagugaguucuccug

SEQ ID NO: 2247472 - RNA, 75 nt, Homo sapiens
ccugacuggccuuuuugugcauggcccagugguaagagacagcccuugcccuggaaccaucuacaguccagcagg

SEQ ID NO: 2247473 - RNA, 56 nt, Homo sapiens
gcaccaagugucauuauggagagggaaacgcucuuuaguccccuaugagcuggugu

SEQ ID NO: 2247474 - RNA, 110 nt, Homo sapiens
uuugccaaaaccuuaagaaguuugcaaguggauuuuuccccagacaagccuccaagugggaguacagucucaacaaaagucauuugcagccuugggggaugcugagcaga

SEQ ID NO: 2247475 - RNA, 70 nt, Homo sapiens
gucuaugagcacauauguaucuaugugcacauuugauaugugugugugugugugagugugugguguaggc

SEQ ID NO: 2247476 - RNA, 97 nt, Homo sapiens
ccaauauuaaugagaaaugagucacuuauuauuggggugcaaauagagagauaaaugacaucaguaauuaagucucaagcccucuuugguauaaugg

SEQ ID NO: 2247477 - RNA, 99 nt, Homo sapiens
gaaaaauaauguucaguauuucuucaucauauuugaucauggaaccccuuagucauguaucagauaccuguugggaaaugcuguugaaaguuauucuuu

SEQ ID NO: 2247478 - RNA, 74 nt, Homo sapiens
acauggcauuuaucaaauaaaauuuauguauguggacauuuuauuuacaugcauauguuggaagaaagccaugu

SEQ ID NO: 2247479 - RNA, 65 nt, Homo sapiens
agugagugaauucucaagagagcugaugguuuuaaaguguggcacuuccucguucuccacucacu

SEQ ID NO: 2247480 - RNA, 72 nt, Homo sapiens
aggucacccuguaggugcuggcagagaaagaaacagaaacuugucucucccagugccucacggaggugaccu

SEQ ID NO: 2247481 - RNA, 128 nt, Homo sapiens
gcauguucacauccccuggggagauugacaucugcuugugcccaggaugcacccuagauggggugagucaguuccugggaugcagugguguuuuguuuuuuuaaauuguccaggugauuccuccgugc

SEQ ID NO: 2247482 - RNA, 76 nt, Homo sapiens
cucuguguguugcacauucuguggauguugacagcgguaugaugacacauaucuacaauuaugguaucacacagag

SEQ ID NO: 2247483 - RNA, 60 nt, Homo sapiens
uacggggguggugggaucauuagaagcccaaaccucgguaucgcacaauauaccccugua

SEQ ID NO: 2247484 - RNA, 56 nt, Homo sapiens
ugcugugucuuucugugaaaagagaaacauuaucucuuuuuacucguucauaugca

SEQ ID NO: 2247485 - RNA, 58 nt, Homo sapiens
cucuuuuguuccuaguuugauccuaauaauagaauacagauauaagguaacaaaaggg

SEQ ID NO: 2247486 - RNA, 107 nt, Homo sapiens
ucaacggguuugauuuuuggggaagccucuuauagcaggaaucuguccagagauuacagcaugggguuggcuacucagaagggaagaggaaaaaggaaacauuuuga

SEQ ID NO: 2247487 - RNA, 77 nt, Homo sapiens
uauguguuuauuguacauacaccgguguguauauguguacauauacacaaguuuguguguguauauauguacauaua

SEQ ID NO: 2247488 - RNA, 56 nt, Homo sapiens
ugcauggaaggcgcuuugugacuuaucgucaagaauaaguugcagaauuccaugua

SEQ ID NO: 2247489 - RNA, 68 nt, Homo sapiens
ucuuuucuggaaguagauagauugugucaguggucaacaccucugccaaagucaacuucuaaaauaga

SEQ ID NO: 2247490 - RNA, 66 nt, Homo sapiens
uaugucugcggacccuuacuaccugugaaugggguguuauugagaaauaggguguuugcagaugua

SEQ ID NO: 2247491 - RNA, 58 nt, Homo sapiens
gaggccacagcuaucagggacauagcugaagccagugucuuugaugucuaugugcuuc

SEQ ID NO: 2247492 - RNA, 76 nt, Homo sapiens
ggcuauaaggagaaauugaacuuacuaucuaaacuaagggugcuugucuuaguuuugaaguuauuuuucuuaagcc

SEQ ID NO: 2247493 - RNA, 70 nt, Homo sapiens
uguaucuauugauuuucaguguucagcugguuguaaaaaauaccagcugcauaaugaaaugucauuuaca

SEQ ID NO: 2247494 - RNA, 72 nt, Homo sapiens
cagcacuugggaggggccacaugcagugugugccgaaguugugcacgugcucauuugaggucuuaccaguug

SEQ ID NO: 2247495 - RNA, 105 nt, Homo sapiens
gucauaguuguaaccaaacugaauaacaugcuuuguuuaugacuuucuuugagcauuuguagcagagcauauucauucggggagggaauauuuuacaauaaggac

SEQ ID NO: 2247496 - RNA, 101 nt, Homo sapiens
ugcauguuuuuaaguaaguuggaugucagagguaacaauuuggauugguuaauuucuucaacagugauggccuuuguauuuaauagcuaugacaauaugca

SEQ ID NO: 2247497 - RNA, 76 nt, Homo sapiens
ucgcuugaguccaagaguuggaggcugcagugagcuaugaucgagccagugcacuccagccugggcaacagaguga

SEQ ID NO: 2247498 - RNA, 66 nt, Homo sapiens
uuagagaaaagcuugcuugcuugaguauaauuauuguuuugccugaguuuguaaacuauucacuaa

SEQ ID NO: 2247499 - RNA, 56 nt, Homo sapiens
ccugggcaguggagguugcaguaagccgagaucacuccacugcacuccauccuagg

SEQ ID NO: 2247500 - RNA, 57 nt, Homo sapiens
aauuugucacuauaaauaagcauuuaguuauaaaacaaguguuuauggugagaaauu

SEQ ID NO: 2247501 - RNA, 71 nt, Homo sapiens
uugcuugaaccugggaggcagagacugcagugagccuacauugugucacugcacuccagcguguguggcaa

SEQ ID NO: 2247502 - RNA, 90 nt, Homo sapiens
cucaauccuggggucuuucugugguguaacucuuggggcgugcccaugggggcugccucgugcugaccacagcaaggcccaaggaaugag

SEQ ID NO: 2247503 - RNA, 85 nt, Homo sapiens
cugcuugcccuccuccaggcucuccccagcuggcaucccccaagaggaaugacugucuagauagagcuugggaagggcacggugg

SEQ ID NO: 2247504 - RNA, 75 nt, Homo sapiens
auuagaggacuagauauucuggcauuuauuuaguaacauauggcacuuaguagcacagaguaucagcacuuuaau

SEQ ID NO: 2247505 - RNA, 83 nt, Homo sapiens
gccugccuaaacuauacacaugugaguucuuuucuaggcuuugguauagaaugguccagcucugcaugucaguucuggaaggc

SEQ ID NO: 2247506 - RNA, 63 nt, Homo sapiens
uuuauuccagcccuggugagccaggcucaaccucugucuuggccacauauugggugggaugga

SEQ ID NO: 2247507 - RNA, 90 nt, Homo sapiens
uguuguguaucuugaucugggugguaguuuaacagguguauacguauguaaaaauucauugagcuauauacuucagacuugugcacaaca

SEQ ID NO: 2247508 - RNA, 72 nt, Homo sapiens
ggggguggcccuuucucuuccaacaguuacccagcucugguaauaguuggcacuggagaaaguugcacuccc

SEQ ID NO: 2247509 - RNA, 57 nt, Homo sapiens
ggaacaguucucucuucuucaaauuucugaaauaguuugagaagaauuagcucuucc

SEQ ID NO: 2247510 - RNA, 92 nt, Homo sapiens
uauccugauuugaugaagugcuaucuuuugagaugcuaaaauguagaauggaauggguaugauuuuguauguugaaugaugguauauggaua

SEQ ID NO: 2247511 - RNA, 58 nt, Homo sapiens
uugcaaugugaugugauuuggauuuguguccccacccaaaucucacaucccauuguaa

SEQ ID NO: 2247512 - RNA, 62 nt, Homo sapiens
ucuuugcuucugacuuuaaugucuuucaaauuuaugagauacacccagugcagaggcuaaga

SEQ ID NO: 2247513 - RNA, 99 nt, Homo sapiens
ggagaccccugggaccuacccucaagcacccuacauaguagauccuacaauauuuuguggcuuagauuuuauguaugggucugcuuccccaugggcuuc

SEQ ID NO: 2247514 - RNA, 80 nt, Homo sapiens
ucuuaguagccaucccagucaacuucagugcuucuaaagugccuuugaguacuacuaguuacugcuaugguuugcagaga

SEQ ID NO: 2247515 - RNA, 64 nt, Homo sapiens
uuucuacagggcuugccagguaacacuuuccucucacguucuacucaagggcucucuguggaaa

SEQ ID NO: 2247516 - RNA, 104 nt, Homo sapiens
gagaccugggacuggcuggggucaagggcucauguuuuugggggugcaccuagcccaggccugccuuauuccaacugagcucuccuccccaccuucccauucuu

SEQ ID NO: 2247517 - RNA, 68 nt, Homo sapiens
guucuucugagaucaugucugugcuguucuucuacaucaugagguacaagcagucagauccagagaau

SEQ ID NO: 2247518 - RNA, 72 nt, Homo sapiens
ggucuaguaaugucugucuuauggaccuggguauuuuuguguuaggugcauauauuuuaggguugcuggauc

SEQ ID NO: 2247519 - RNA, 93 nt, Homo sapiens
cucacccguucuacuggcaacuggaguuuguucaagaaauaccugaguugguucuuuaacugucgaguucgauuguccaaguggaaggguggg

SEQ ID NO: 2247520 - RNA, 57 nt, Homo sapiens
ugagaugaagucucacucugucgccaaucuguagugcaguggugugaucucggcuca

SEQ ID NO: 2247521 - RNA, 62 nt, Homo sapiens
cuuaaacaucccuaccugguagcucugaagagaacaauggaucuaccagcacaguguuugag

SEQ ID NO: 2247522 - RNA, 76 nt, Homo sapiens
ucgccugagccccagagguugagucugcagugagcugugaacaugccacugcacuucagccugggugacagagcga

SEQ ID NO: 2247523 - RNA, 69 nt, Homo sapiens
auuucugcagcuaaggacccccugguugccucuguggcccagcaaucacaggucuuggcugcaugaaau

SEQ ID NO: 2247524 - RNA, 55 nt, Homo sapiens
ugugucuaucaaggaaguggucuaguucaucuagguuaucaaauugguaggcaca

SEQ ID NO: 2247525 - RNA, 59 nt, Homo sapiens
gagguggagagccagagugcggacuugccugauugagcucucacuuggcuuugccccuc

SEQ ID NO: 2247526 - RNA, 56 nt, Homo sapiens
gggaaggcaugauguuuuggaggccauaggauggagccuaagaugcagccuauucc

SEQ ID NO: 2247527 - RNA, 67 nt, Homo sapiens
augagauuugggaggggccaagaaugaaaugauaugguuaggcuuugugucccuacccaaaucucau

SEQ ID NO: 2247528 - RNA, 63 nt, Homo sapiens
acuuguuuucaugggaucacaggcuguuccucugggagaugcuaggagagaugaaacacaggu

SEQ ID NO: 2247529 - RNA, 61 nt, Homo sapiens
ucaagagauauaugcugguuuaagauacacaaaaacuugaacaguacuugagaucuuuuga

SEQ ID NO: 2247530 - RNA, 72 nt, Homo sapiens
auauaaaagcuucuuggagugucucuguuucaacucucucauuuugcacaggguuacauucuaagguugugu

SEQ ID NO: 2247531 - RNA, 91 nt, Homo sapiens
ugguggccagaacauuaucacuuugauaguuuaaauggcauugaccaauguauuugaaucagguacaaguuugaagauuuucugguuauua

SEQ ID NO: 2247532 - RNA, 64 nt, Homo sapiens
auugugaauagugccgcaauaaacauaugugugcaugugucuuuguaguagcauuauuuauaau

SEQ ID NO: 2247533 - RNA, 130 nt, Homo sapiens
uaugaaaugcccacaacuaacaucacacucaauggugaaagacugaaagcuuuucuuuccucuaagauacagaacaaggaaaggaugcucacucuuaucacuguuaaucaacauaguacuggaagucaua

SEQ ID NO: 2247534 - RNA, 59 nt, Homo sapiens
uaugugcauaugaagcacagacaugcaugugugugugugucuguguguguguguccgug

SEQ ID NO: 2247535 - RNA, 100 nt, Homo sapiens
ugagauggagucucgcucugucacuaggcuggagugcaguggcaugaucucggcucacugcaaccuccgccucccggguucaagcgauucuccugccuca

SEQ ID NO: 2247536 - RNA, 75 nt, Homo sapiens
uaguuacagucacaauuuguaccuuuuucuccacuccaaacugagacuaagagggaaauuguuggcugcuaacug

SEQ ID NO: 2247537 - RNA, 63 nt, Homo sapiens
uuuuggacuugcuccccuguccucugugccuuuccucaaagggcaccuagcacagucucaaag

SEQ ID NO: 2247538 - RNA, 74 nt, Homo sapiens
gcccaccaaggcagacuguggaguucuuucucaguggugagacaaaggcccauagcugcuuggcuggccugggc

SEQ ID NO: 2247539 - RNA, 68 nt, Homo sapiens
ggguacacgugcccaacaugcagguuuguuacauauguauacaugugccauguuggugugcugaaccc

SEQ ID NO: 2247540 - RNA, 79 nt, Homo sapiens
cccucggccacccuuccacacccuggguacccaccuucugacccuggugugccuguggugggaagaggcugagccaggg

SEQ ID NO: 2247541 - RNA, 84 nt, Homo sapiens
cucaggacacaccacuucaaaguaugacugcaggaggcucuugaaauauacuucuuuggcauauuuuaagcugguuauucugag

SEQ ID NO: 2247542 - RNA, 84 nt, Homo sapiens
caguugugagugguuaagaugcagucauacuggaguauacuggaguauacuggaguaugcugagucuaugauccaacaugacug

SEQ ID NO: 2247543 - RNA, 59 nt, Homo sapiens
uccagacuagguaaccaccuacagauacuuucuaucccuauggauuugccuauucugga

SEQ ID NO: 2247544 - RNA, 79 nt, Homo sapiens
augucuuaaaaugagcucauuaaaguaggaccuaguccacuaugacugguguccuuauuagaagaguaaauguagacau

SEQ ID NO: 2247545 - RNA, 60 nt, Homo sapiens
guccaggaguuugaggcugcagugagcuaugauuauaucacugcacuccagcuugugggc

SEQ ID NO: 2247546 - RNA, 59 nt, Homo sapiens
ugugaauagugcugcaaaaacauacgugugcaugugucuuuauagcagcaugauuuaua

SEQ ID NO: 2247547 - RNA, 78 nt, Homo sapiens
ucaauauagaaaagauacaguaugcaugugguauuauuauuuuauggaaccacugacauauaugugaucugucauuga

SEQ ID NO: 2247548 - RNA, 67 nt, Homo sapiens
cgauacuccugucucagcugagauuacaggcgugagccauuucaucucacuaagaacagcuguauug

SEQ ID NO: 2247549 - RNA, 123 nt, Homo sapiens
gaggugggagguucgauugagaccaggaggcagaggcugcagugaguugagaucaugccgcugcagugaguugagaucaugccacugcacuucagccugggugacagagcgaaacccugucuc

SEQ ID NO: 2247550 - RNA, 66 nt, Homo sapiens
auguaugucuucuuuagauaagugucucuucauggccuuugcccacuuuuuaaugggguuaugcau

SEQ ID NO: 2247551 - RNA, 75 nt, Homo sapiens
gcaagacuguggagaaaauuaaagcaguuaaggggaauagaguguuagcugcguguagaguucucacuguuuugu

SEQ ID NO: 2247552 - RNA, 69 nt, Homo sapiens
gccaauaucaaugaccaugguccagggaacagucucaagaaguccugagaacaugcacuugagguuggc

SEQ ID NO: 2247553 - RNA, 74 nt, Homo sapiens
ugaauuugguuggcuaguauuuuguugaggauuuuugcaucaauguucaucagggguauuggccaauacguuua

SEQ ID NO: 2247554 - RNA, 90 nt, Homo sapiens
gcagauuaacaauuuguauuuagcaauggagguaguguauccuugagauuacaaagcagucauuaguuauauugacagauuuaaauuugc

SEQ ID NO: 2247555 - RNA, 55 nt, Homo sapiens
cuucagcaugacauuagcuauggaucugucauuuauggcuuuuauuauguugagg

SEQ ID NO: 2247556 - RNA, 71 nt, Homo sapiens
auaaguaauaguggcuuggacuaaauauuuguugaauaaauguuuuaaaaaacaggcuaccuacaauuugu

SEQ ID NO: 2247557 - RNA, 84 nt, Homo sapiens
uaaacuaauuuuacugugcuuuacuguguugccuuuauuguuaaugaaugguaaagaaaagcacuguauuuaaaauuggcuuua

SEQ ID NO: 2247558 - RNA, 69 nt, Homo sapiens
cuacuguugugcgcgcuugggcuaucuucaaguccugccuauuucaaaugguccacgugaacauuguag

SEQ ID NO: 2247559 - RNA, 56 nt, Homo sapiens
aggaggcuuagggucuuccaaguggccagggucuugagaggauucgccagccucuu

SEQ ID NO: 2247560 - RNA, 70 nt, Homo sapiens
gguggugggcccggucaccauaagugaggagggccauaagcauguacuuauuguggcugacccaaacacc

SEQ ID NO: 2247561 - RNA, 83 nt, Homo sapiens
uucaguggacauguugugaagaugugaagcaagcaggucauucccaccuccuuucaucauauuuaucauauaugguggcugag

SEQ ID NO: 2247562 - RNA, 58 nt, Homo sapiens
ucuuuaugaccaaagaaaugcuauaggaagauuaucucuguggcuuuuggucuaaaga

SEQ ID NO: 2247563 - RNA, 77 nt, Homo sapiens
agcuguucuuacuuuguccuucaaggugugucauucuuuggcagauggccaggccggggacagaacugaagacagcu

SEQ ID NO: 2247564 - RNA, 98 nt, Homo sapiens
aaggggaacaaaugagaucguguaggcgaugccacuuugcacauucugaagcacuaaaugaaugugcaauggugucaccacauggucuuuugccucuu

SEQ ID NO: 2247565 - RNA, 110 nt, Homo sapiens
cuucauucuccagcaaugaagaggaaacauggccauucagacuguggaggaacuggaugaggagacaucuggaaguacagucuggaggccuguguuggggagagauggag

SEQ ID NO: 2247566 - RNA, 67 nt, Homo sapiens
cuccucugacagugugaauauugacuugcacuuauaaaggucagacaguuccacuaguuaauaggag

SEQ ID NO: 2247567 - RNA, 130 nt, Homo sapiens
caugggcucuggguuaguugguuugcaucuggaagacacccuuguaggcaaauaauuuacuaucuuuagaaauuggcuaucccugggaggggcagucucuccagggucagcaaggccccagaugucaaag

SEQ ID NO: 2247568 - RNA, 98 nt, Homo sapiens
gcaguauugguugcuuacccuugugauugcacggcugccuggcugcugaggcucaccgcugcugcccugcaucacgagaguauuguaccauauauugc

SEQ ID NO: 2247569 - RNA, 112 nt, Homo sapiens
uugaauaaaagauuauacagcuucuagaagugauaauguuaggcuuuauucauuauauauggcuggauaaauuacuugauuuauuguauuuggucuguuaacauuuauuugg

SEQ ID NO: 2247570 - RNA, 61 nt, Homo sapiens
agcaacauagaaauuugggugggaggcuaagaagcagauauauucaaguuucuaagaugcu

SEQ ID NO: 2247571 - RNA, 57 nt, Homo sapiens
ugaaauggugcggucugcagcauguguccaaggccacguggcaggagcaucguuuca

SEQ ID NO: 2247572 - RNA, 57 nt, Homo sapiens
aaggcagauaugaugugaaagccuugccuuggccuuccacguggucuaucuguccuu

SEQ ID NO: 2247573 - RNA, 81 nt, Homo sapiens
ccuccaaaguaacgcauacaguagaaaacaauggauuugaaaacaaaugcaaauuuuacuauuugagcggggcuguagagg

SEQ ID NO: 2247574 - RNA, 57 nt, Homo sapiens
auuaaagaacugagggcugugcgcgguggcucaccccuguaaucucaguacuuuggu

SEQ ID NO: 2247575 - RNA, 63 nt, Homo sapiens
caggcuugugacuauuccaaagaaugaauuacauggagugaugcaauggaaugucuaagccug

SEQ ID NO: 2247576 - RNA, 70 nt, Homo sapiens
auguguccuugccugguuuugguauuagaguaauacuaauacugguaucauggaaugagguuggacauau

SEQ ID NO: 2247577 - RNA, 65 nt, Homo sapiens
aauggaaauugauggcuaauaugaaaagaugaaagucugaguucaugaggccauucaaauccauu

SEQ ID NO: 2247578 - RNA, 60 nt, Homo sapiens
auggaagcugauuagauaguacucaccagaucaagggugggucugccuuccccagcccau

SEQ ID NO: 2247579 - RNA, 58 nt, Homo sapiens
uaucauuguguuauuucuuccaccagggcgcagcagucuggaaauagaaacaauggug

SEQ ID NO: 2247580 - RNA, 60 nt, Homo sapiens
ggcuggaguguguugcagaugaaggaagauuucucaucaccccacacacucucugcagcc

SEQ ID NO: 2247581 - RNA, 129 nt, Homo sapiens
aaacuaacuuuaggcaaaacaacauacagccaaaccacauuuucucaucaacgcuguaaaaaaaugauguugaaugaaaugaugucauuugaggaccugcuauaguugguuugcuuaaaguugcaguuu

SEQ ID NO: 2247582 - RNA, 96 nt, Homo sapiens
cucuguggcccaggccggagugcaauggcgcaaucucggcucacugcaagcuccgccucccggguuugugccauucuucugccucagccuccagag

SEQ ID NO: 2247583 - RNA, 62 nt, Homo sapiens
ccugcuaaaugaaagaagccacaaacaaaaggccauuuuugugguauuauuccauuuauagg

SEQ ID NO: 2247584 - RNA, 55 nt, Homo sapiens
guggagacaaaggcugagugaggacuuggauuuuggcucagaaggcugccuucac

SEQ ID NO: 2247585 - RNA, 59 nt, Homo sapiens
ugaaggagggugaauucuguuuguuauaugacuaugacauguagagaacuucucauuca

SEQ ID NO: 2247586 - RNA, 65 nt, Homo sapiens
gcugacucaguagguaagacauugccacucacaaggguaagugcuguguuguuaccuaaggcagu

SEQ ID NO: 2247587 - RNA, 69 nt, Homo sapiens
aggaaacauggcaggugcacuggcuuugaaguugccguggugguugcaauccugcaucugucuguuccu

SEQ ID NO: 2247588 - RNA, 87 nt, Homo sapiens
uuuuguauuuuuuauggcuguuuuuuauguuacagcagcagccgugaguagcuguggcagagacggaauagccuguaaagucugaaa

SEQ ID NO: 2247589 - RNA, 89 nt, Homo sapiens
gucuugugauuccuaaggagcagagagcccuguuucaauacugggugagucuggaauggcucucuguccuuugcauucuccuacaagau

SEQ ID NO: 2247590 - RNA, 58 nt, Homo sapiens
cagguucaagcaauucuacugccugagccuccucaguagcuggaauuacuugcaccug

SEQ ID NO: 2247591 - RNA, 60 nt, Homo sapiens
uguauuaguuuccuguugcugcuguaacaagugauugcagaugcagugguuaacaauaca

SEQ ID NO: 2247592 - RNA, 56 nt, Homo sapiens
aaggcagaggaagggugaauucacucuccuagagcugaaacaucuauccucuccuu

SEQ ID NO: 2247593 - RNA, 60 nt, Homo sapiens
uaguagcagcaauuuacuccauacuucaguucugcugugugguuuggaauuuuguuacua

SEQ ID NO: 2247594 - RNA, 71 nt, Homo sapiens
gcuugaauucaugaggcggauguugcagugagcugagaucaugccauugcacuccagccuggggcacaagc

SEQ ID NO: 2247595 - RNA, 75 nt, Homo sapiens
agaagguaagcaccauauuguuuuucccaggagucuagagcagccauuuuugagcuugugaagaacauaccuuuu

SEQ ID NO: 2247596 - RNA, 77 nt, Homo sapiens
gaugcugguuuaaaaugcaaauuccuagauucucucuccaaucuagcugagucagaauuguauuuuaaaccagaauc

SEQ ID NO: 2247597 - RNA, 61 nt, Homo sapiens
auuuuaugggcacagaauuguuuauaauauuucuuuaugaucuuuuuaauguccaugggau

SEQ ID NO: 2247598 - RNA, 90 nt, Homo sapiens
aaauuuuauuccaugucaauuuggccuuuguaugcaguauccuagauggauucuuucauauaaaggcucaguacugaacagaaaaaauuu

SEQ ID NO: 2247599 - RNA, 75 nt, Homo sapiens
uuuaauucuuuccacucauuuuuccagacugccaauuaaguuuuguuuugguuaggauggguggcauguauuaaa

SEQ ID NO: 2247600 - RNA, 57 nt, Homo sapiens
uguucaugugagucuguauuaacuagugguaaaccaguuuuaaauuucacauggaua

SEQ ID NO: 2247601 - RNA, 55 nt, Homo sapiens
gcuccuucaggugguagcuguuguggcagaauagaagagugcuggacugaggagc

SEQ ID NO: 2247602 - RNA, 80 nt, Homo sapiens
auugcaaguguccuuccaugagugagugaauugcuaaacaaacgguaaugcacucgaaucauggaauauuauucagcaau

SEQ ID NO: 2247603 - RNA, 67 nt, Homo sapiens
agaagggaaauuaauuaugccagaguuuauggucaagguauuuugugcugcaauuaauuucccaucu

SEQ ID NO: 2247604 - RNA, 129 nt, Homo sapiens
aaauuaucccuuccuuaaauguucgguagaauuuauuaguaaugcuaucugggccagggguuuuguuuguggaacuuuuuuuuagugguauuaauuauacuucuuuauacauauaaggauaucuaguuu

SEQ ID NO: 2247605 - RNA, 77 nt, Homo sapiens
uucuuugucagauauguaguauggaaacauugucucacagacaguggcuuguauuuuuauauuugcuugacagggga

SEQ ID NO: 2247606 - RNA, 58 nt, Homo sapiens
ggacauguggauugaucuggcucuuugauuuugugaagagugguuuucaaauaugucu

SEQ ID NO: 2247607 - RNA, 64 nt, Homo sapiens
acuucuugacucaaugaugagggaagaacaaaaucagucucuucaucagguaugucagcggagu

SEQ ID NO: 2247608 - RNA, 74 nt, Homo sapiens
uguagguguuugaugcauuuugaguuaauguguguauauggcaugcauuguggaucuaaaugcaucuuuuugca

SEQ ID NO: 2247609 - RNA, 56 nt, Homo sapiens
guugguucuguuuaugugauggauuacguuuauugauuugcauagguugaaccagc

SEQ ID NO: 2247610 - RNA, 78 nt, Homo sapiens
ccccugagagcaugaggacgaugagucuggagggugaagucugcgauuucaguacacguguucucauuuaucaagggg

SEQ ID NO: 2247611 - RNA, 58 nt, Homo sapiens
auucuucuaucucuguguuuccuauaaaugaaucauuggauuugcagaguaggugaau

SEQ ID NO: 2247612 - RNA, 64 nt, Homo sapiens
cucugauucauauuaaacacucaagaaaugauuguuguucuugcugguuuucauaugagcagag

SEQ ID NO: 2247613 - RNA, 74 nt, Homo sapiens
ugagaugaagugauguaaaacauggggcuacuguuuucucuccaucuccccucgccuugccucgccucaccuca

SEQ ID NO: 2247614 - RNA, 58 nt, Homo sapiens
gaaagaaguugacccuccucccgugccgagagcuugggaugaaaauagcuucuuccuc

SEQ ID NO: 2247615 - RNA, 84 nt, Homo sapiens
uauuagguuggugcuaaggucauugugguuuuugccauuacuuucaauggcaaaaacugcaaugacuuuugcaccaaccuaaua

SEQ ID NO: 2247616 - RNA, 60 nt, Homo sapiens
cacuucacacugugggguucuugucaucaguaucucugaagcucuuccacagucgaggug

SEQ ID NO: 2247617 - RNA, 81 nt, Homo sapiens
uugauuuuguuugggagaauuuuauguuaguccuuuuuauuaucucaagaaggguccuggaaucuacuaaagcaaaaucaa

SEQ ID NO: 2247618 - RNA, 94 nt, Homo sapiens
ccuuuuuggauucacuucugauuguucugaguauaucaaguugauucuuaguuuagugcugauaugcuuugaacucucuggaagucucaagagg

SEQ ID NO: 2247619 - RNA, 56 nt, Homo sapiens
gacucuguagacaaucacaucugaugguauaaccugggaugugugcuacaagaguc

SEQ ID NO: 2247620 - RNA, 56 nt, Homo sapiens
gggugagucucuauucuaacauaaccaccauucuuguaagaagaguagagacgccc

SEQ ID NO: 2247621 - RNA, 65 nt, Homo sapiens
gucucacagcuagcugcuuuauuauauguagggaaaccuggcaaaccaagcaguaguuguggggc

SEQ ID NO: 2247622 - RNA, 83 nt, Homo sapiens
uuugccccauggcuguuucugcaaugucuaguuaccuuucuuuccagagaagcuggacguuugugagagucauguuuugcaaa

SEQ ID NO: 2247623 - RNA, 61 nt, Homo sapiens
guggguaaaucucuguucagggcuuucagcucugaaggcugugagaccccagauuucccac

SEQ ID NO: 2247624 - RNA, 88 nt, Homo sapiens
ggagaauggcaugaacccgggagguggagcuugcagugagcagagaucacgccacugcacuccagccugggcaacagagcgagacucc

SEQ ID NO: 2247625 - RNA, 71 nt, Homo sapiens
ggagugaccaaagauagcucaaguuuuggaaugaaugacuuugaagcuguacuaguucuuugaaucauucu

SEQ ID NO: 2247626 - RNA, 90 nt, Homo sapiens
gacaggauuaguauuacugaguuuuccuuuugucccaggcucuaauauggcuuggcauggggcagaacauuacaacauaccagucguguc

SEQ ID NO: 2247627 - RNA, 63 nt, Homo sapiens
gagcugagaucaugccacugugcuccagccuccagccugggugacagagcaggacuucaucuc

SEQ ID NO: 2247628 - RNA, 56 nt, Homo sapiens
gagcuggacuucuuaccuuuucaaagaccaagaaaagucugagaugauuccagcuc

SEQ ID NO: 2247629 - RNA, 59 nt, Homo sapiens
cuuuaucauagugcaguuuucugacuccugugucagggucaccugccgcuguggaaggg

SEQ ID NO: 2247630 - RNA, 55 nt, Homo sapiens
cucccaggcuacaggaucuuugacugagcucucaguggauguuguggccugggag

SEQ ID NO: 2247631 - RNA, 87 nt, Homo sapiens
cuccagagcaacuguuaacauguuguggauaaugccuguuaagauuagauauauuuaugacauguuuauaaaccucuuccuugggag

SEQ ID NO: 2247632 - RNA, 55 nt, Homo sapiens
uguuccaaguaauuaaagccaugcauaacaugguaggcaagauuacuuacgagca

SEQ ID NO: 2247633 - RNA, 61 nt, Homo sapiens
gccugcagguggucugggaaucagaggguaauaucuuugguccccacuccccugccaaggc

SEQ ID NO: 2247634 - RNA, 56 nt, Homo sapiens
gacuuaaucacacuagauggccuacuucuuaaugcuaucacauuggugauuaaguu

SEQ ID NO: 2247635 - RNA, 73 nt, Homo sapiens
uggaugagaauccaggaacaggguuuagcauuggugagaguggcaagaugacucagucuuggauuuuuaauca

SEQ ID NO: 2247636 - RNA, 73 nt, Homo sapiens
cugagucuggugcgggcaaugucugaguagcuuucugugugagagcaccacaauuuccugccuaagaguucag

SEQ ID NO: 2247637 - RNA, 74 nt, Homo sapiens
ggagguugcccugcgagcauuguaggaaguucagcugccccucggcugacacccauagaugcuaguggcacucc

SEQ ID NO: 2247638 - RNA, 57 nt, Homo sapiens
ggcaaggauguuuuucuggcaaggauugaaaaggaugcuggcaagaggguuuuuguc

SEQ ID NO: 2247639 - RNA, 63 nt, Homo sapiens
auggauuuauuaucagauaagucacuauuuauaaaaagcaugacuuguccagugauaguucgu

SEQ ID NO: 2247640 - RNA, 121 nt, Homo sapiens
gauguguuguagacucuggauucuguuauguucuugagaguuugguguuuuguuucuguuaacaugcaguuaaucacagcugaacucaaacuccaaaucuagcuucccugaggcaagcauc

SEQ ID NO: 2247641 - RNA, 70 nt, Homo sapiens
agccauucucaaaguguggucuguggguucuuguagagucccaagaacuuuuuaggaggcacuugaggcu

SEQ ID NO: 2247642 - RNA, 63 nt, Homo sapiens
cugagaacugcagggagcugcauucugccaacaacgugagucagcuuagaagcugguuuucag

SEQ ID NO: 2247643 - RNA, 58 nt, Homo sapiens
caguucuuaugcugguggcuuccaaaccucacuuugagaaauacugccuuaggagcug

SEQ ID NO: 2247644 - RNA, 77 nt, Homo sapiens
uccagaaccugugacuauguuaccuuacacaucaaaauaauuuuucugaugugauuaguuaagaugcuuauaaugga

SEQ ID NO: 2247645 - RNA, 74 nt, Homo sapiens
agaaccacugggcuggaguagugugauagaacaagaaagcagaacacugugcauacugggagguuggguguucu

SEQ ID NO: 2247646 - RNA, 104 nt, Homo sapiens
ucuucuuuuucauuaagauuauuuuuaaccuacuaucaugacuguuaaguagauagcucauaaaaaggguucagaucauuaagguagguuuaaaagaaagagga

SEQ ID NO: 2247647 - RNA, 76 nt, Homo sapiens
gugccuguagccagaggacuggcugguggaguggucauucucccugagcaaaguuuucuguacuuguaauagguac

SEQ ID NO: 2247648 - RNA, 62 nt, Homo sapiens
gguuucuuugccaccaguggucuuggggagcccauccuuccaagacuagggagcagaaagcc

SEQ ID NO: 2247649 - RNA, 56 nt, Homo sapiens
ccauuucacucuuccugaaggacccggcaggcggguggaggaggggugggaaaugg

SEQ ID NO: 2247650 - RNA, 59 nt, Homo sapiens
uagcagguucugggugggaaugaggccaccauggggccauggcucacugagaacagcua

SEQ ID NO: 2247651 - RNA, 59 nt, Homo sapiens
gugcaugcuagugguugccaguuauguugguaguggaguaauggcaaguuuaguagcac

SEQ ID NO: 2247652 - RNA, 68 nt, Homo sapiens
ggguauaugugcacaucgugcagguuuguuacauauguauacaugugccauguuggugugcugcaccc

SEQ ID NO: 2247653 - RNA, 63 nt, Homo sapiens
accuaacuaugucaaauaaaaugagggcaaagaauugacccuuggaauuagcauagauuaggu

SEQ ID NO: 2247654 - RNA, 60 nt, Homo sapiens
gagcuaggcuagggggagucgcugauucugcuuuucucugugguccccugagucuggcuu

SEQ ID NO: 2247655 - RNA, 65 nt, Homo sapiens
gaaacagggggaacgaauuaucuggccccuggggggcuuucagguaagaugcuuucucuuauuuu

SEQ ID NO: 2247656 - RNA, 59 nt, Homo sapiens
agaaaucuauguuuugguuagauguauuuuuucaucuuuuauagaauauaggucauucu

SEQ ID NO: 2247657 - RNA, 59 nt, Homo sapiens
cugacuuccuagccuucugguugaccggcagccccagugaccacagcagggaaugucag

SEQ ID NO: 2247658 - RNA, 64 nt, Homo sapiens
auaucucagcaacuaaagauccuuaggggaaauuuacccccaagauuuucuguugcucagauau

SEQ ID NO: 2247659 - RNA, 89 nt, Homo sapiens
gccucagagaacugaguuauuuucuuucccccucuugcacuauuacugacucauagcauggacuugagcaaauuauuuagucucuaggc

SEQ ID NO: 2247660 - RNA, 130 nt, Homo sapiens
ggcaaaaaugugaaugacaaaaaacgauagaagguuuaaagcaugauuuuuucuccaaggggaggaugguucuuaggauacugaagucgguuaaugacaagucuaaugaaauacauuuuaaguuuaugcc

SEQ ID NO: 2247661 - RNA, 103 nt, Homo sapiens
ugguggaagaaauguugauggaagcugaaggaauucacuguguuccuagaaucuguggugaauuagggcauugaacugaauucuucaggcauuccuuccauua

SEQ ID NO: 2247662 - RNA, 110 nt, Homo sapiens
agcaaguuagaauggcauauucauagaguuagaaagaaauguuuguagaaguuacacaaacaaccuuuuuuuaauuugggaaaucuuuuuauaagcuucucuccacugcu

SEQ ID NO: 2247663 - RNA, 57 nt, Homo sapiens
uuauugccugauugaggucauuacccuauggugguaaugacaucagcaauguaauaa

SEQ ID NO: 2247664 - RNA, 76 nt, Homo sapiens
uagcauaaauuaauaggauuuaccaggaauaacagaugccucugucauucaggaaauucuaaguauuuaaaggcua

SEQ ID NO: 2247665 - RNA, 59 nt, Homo sapiens
uuuuccagugggacucccauuaucacuauguugauauucuugauggugucccaugaaaa

SEQ ID NO: 2247666 - RNA, 92 nt, Homo sapiens
gugguguauuuaauuuggaccaguuuauucauuuuaaguuguuguugaacaaacacacaaaguaggcagugggcuggaaauggggacauugc

SEQ ID NO: 2247667 - RNA, 69 nt, Homo sapiens
agguucugcuccuugggaugugaauucacugggucuagagacuugagcaucucuaaaaggagcaaaucu

SEQ ID NO: 2247668 - RNA, 84 nt, Homo sapiens
gugggagcaguagagcugguaagaaguguucagguuguggauacauuuugaagacuaaguuaucaggauuugcugauggcuuau

SEQ ID NO: 2247669 - RNA, 55 nt, Homo sapiens
ugucacugugaguuugacugcucuggguaccuguuguagguggagucauauggca

SEQ ID NO: 2247670 - RNA, 60 nt, Homo sapiens
cucagaaugcgcagaguggugugugcaugcagcaacguguauacacccugugcaucuggg

SEQ ID NO: 2247671 - RNA, 73 nt, Homo sapiens
uucuuaguggaguauaaauuauuaggaucauuuaguuuuaugccuagauuaucccugauuuguccacugggag

SEQ ID NO: 2247672 - RNA, 69 nt, Homo sapiens
ggaaauuguguucuggagauaaagccaagguuguagcuggacaacuuuugcuagugcuuuagaacuucc

SEQ ID NO: 2247673 - RNA, 94 nt, Homo sapiens
aauaaagaaaaguaguuauuaauauacuuuuauucuuauaaauaaaccuuugaaggauauaagagugggguguuagggaugcugucucuuuauu

SEQ ID NO: 2247674 - RNA, 88 nt, Homo sapiens
ucuauugaagucaccaaggccugggcugugcaucucugaaaggaaagcccuuugagaucaaugccuauggcuuucaagcaucgcugga

SEQ ID NO: 2247675 - RNA, 79 nt, Homo sapiens
cucagguagguaaugcagggccaguuaaaaaggggacuguaacaggcuacucuugcauugcuauaaagaaauaccugag

SEQ ID NO: 2247676 - RNA, 66 nt, Homo sapiens
gcucuggacguugaggcugcagugagccgugaucacaccacugcacuccagccuggccaucagagu

SEQ ID NO: 2247677 - RNA, 90 nt, Homo sapiens
uacucauauuucuggugucaagauuuguaggacagagauauaccaugauauagccuguggucucacaccuucauauuaugaugcugagug

SEQ ID NO: 2247678 - RNA, 56 nt, Homo sapiens
augaaugcaucuaucaaagcauacgaauggugaguugcugugauagaaugauucau

SEQ ID NO: 2247679 - RNA, 88 nt, Homo sapiens
ggagaaucgcuuggacccaggaggcagagguugcaaugagcugagauugugccauugcacugcuucuugggugucacagcgacacucc

SEQ ID NO: 2247680 - RNA, 58 nt, Homo sapiens
ggacacguagaugccgacuagcuguauggagcgugcuguucuaggcauccacgugucu

SEQ ID NO: 2247681 - RNA, 84 nt, Homo sapiens
cuauuaggcuggugcaaaaguaauugugguucuugccauugaaagugauggcaagaacugcaauugcuuuucacaaccuaauag

SEQ ID NO: 2247682 - RNA, 128 nt, Homo sapiens
auuauccaguuccaaagcuacuuccacauuuucagguaucuuuuuagcagugucccacuccuugguaccaauuuucuguauuaauccauucuugcauugccauaaggaaauaucugagacuggguaau

SEQ ID NO: 2247683 - RNA, 76 nt, Homo sapiens
gaaaaaugcuguuccaggaccuaucacagcuuuauaaaaaccaaaucccuugugguggggccugugcacauuuuuu

SEQ ID NO: 2247684 - RNA, 97 nt, Homo sapiens
gagugauaucuauaccuuggcuugugguuuuauaaacgugaccucauauucagagucuuugucuuuaaaauccaaaagaucaguuagauuuuuauuc

SEQ ID NO: 2247685 - RNA, 95 nt, Homo sapiens
gaggcgggaggaucauuugaacucgggaggcggagaucgcagugagccaagguggcaccacugcacuccagccucguggacagaaacucuaucuc

SEQ ID NO: 2247686 - RNA, 65 nt, Homo sapiens
gcagcccugauacauucuucugccuguaaggaggauuccacaggccagugccaucaggguuuugc

SEQ ID NO: 2247687 - RNA, 91 nt, Homo sapiens
aaguaaaaguaggguuccauggaaaaagcagcuaguucaacucacaacucagagucacaagugcuuuuccuggagacagcccauuguacuu

SEQ ID NO: 2247688 - RNA, 92 nt, Homo sapiens
ugaagaauuggucucgagagaaaaugcuucacugaaauaauucaggaaacugcccuuauggcaaguggggcagauucucuuccuguccuuca

SEQ ID NO: 2247689 - RNA, 60 nt, Homo sapiens
ggcugagggacauauaugaggugugauuuuuuagugucauaugguguuugcuauucagcu

SEQ ID NO: 2247690 - RNA, 76 nt, Homo sapiens
cauggggaguacuugagauaggagcuguuguucucuucuggccuaaacuaagacccgucuccugucucaccccaug

SEQ ID NO: 2247691 - RNA, 128 nt, Homo sapiens
agggcacaaaagauuggccagaccaggugugccauuugcauagugcaugaagaagcuggccacccuacccuaaucuuugauuaugcagauggguucuguacuuggcuggcaccauuuugccuguuccu

SEQ ID NO: 2247692 - RNA, 127 nt, Homo sapiens
ccucacggugacucaguuuccccaccugcaaagaggcgaugaugacgaggucucuuggagccaucugugaaauggagguagagaugggaucuccauccuucccucggagacacuugagaacuggagg

SEQ ID NO: 2247693 - RNA, 62 nt, Homo sapiens
guuccuauucuagacguuccauauauggaauuccacagauggaaugccauuuauaauggaau

SEQ ID NO: 2247694 - RNA, 58 nt, Homo sapiens
gcccaggauggagugcagugauacgaucuuggcucacugaaaccacugccuccugggu

SEQ ID NO: 2247695 - RNA, 91 nt, Homo sapiens
auucaaguuaaucuggacccuuagaaugugaucuuauguuagaaauagaguccuugcagaggucacuaguuaaggugagguuauacugaau

SEQ ID NO: 2247696 - RNA, 56 nt, Homo sapiens
auauagacacugaaaucccugccaacccaguuugcaugacaauuucaggucugugu

SEQ ID NO: 2247697 - RNA, 87 nt, Homo sapiens
gauuaacauuuuuugucaguggacugugaaaggcaguccucaauuugggugggucugccuuucccaguucacugacucaauguaauc

SEQ ID NO: 2247698 - RNA, 77 nt, Homo sapiens
auuucccaaacugcuccagagagauguuuauagauauuaagaaaacuaacauucuaugguuuaauaguuugggaaau

SEQ ID NO: 2247699 - RNA, 67 nt, Homo sapiens
ggaccugagggaaaaaauuuauaugagcugacgaaaauguugauggagagaauuauucucucagucc

SEQ ID NO: 2247700 - RNA, 68 nt, Homo sapiens
ucgcuugaacccuggaggcggagguugcagugagcugagaucgcgccauugcacuccagccugagcga

SEQ ID NO: 2247701 - RNA, 82 nt, Homo sapiens
cccugacugaauccugaugacacagugcugcaccuaaaaagugucugaagugccagcugcgucaucaaggaaaggcaaaggg

SEQ ID NO: 2247702 - RNA, 127 nt, Homo sapiens
caggaggaggagggaaugggagaaaugaaaggagugagaauauguguccugguguccaacuugauucccuaggucuggucccugcacauauuuucccaauauaucacccagcuuucacuucuacuug

SEQ ID NO: 2247703 - RNA, 58 nt, Homo sapiens
uagcaguagacagacuuuggcuacuguguguccauuuccaauuauugaucuacuguug

SEQ ID NO: 2247704 - RNA, 60 nt, Homo sapiens
gugacagucaaagacaugacuugaugcggagaugugaagugugacuuuuuugacugucac

SEQ ID NO: 2247705 - RNA, 59 nt, Homo sapiens
guguagacugcccuuuguaggaugugauuuuaaaggaauuuucagagugcagacuauac

SEQ ID NO: 2247706 - RNA, 93 nt, Homo sapiens
cugaggcaggagaaucacuugaaccugggagguggagguugcagugagccgacauugcaccacugcguuccagccugggcgacucugucucag

SEQ ID NO: 2247707 - RNA, 88 nt, Homo sapiens
ggagaaucacuugaaccugggaggcagagguugcagugagccgagaucgcaccauugcacucuagccugggugacagagugagacucc

SEQ ID NO: 2247708 - RNA, 101 nt, Homo sapiens
cauuccgucaugcauguuuagacuucauggcuuuuuaaaucauguuguagugugguuacaaugaagauaaaagcuagaggaaaacacuccaugcaggaaug

SEQ ID NO: 2247709 - RNA, 69 nt, Homo sapiens
cagucacuucaugguuucuuggacaggcagauccuggccauguucauguaauuccauaagguaaggcug

SEQ ID NO: 2247710 - RNA, 60 nt, Homo sapiens
gagaaugaugguuuccagcuucaucuaugucccuacaaaggacaugaacucaucauuuuu

SEQ ID NO: 2247711 - RNA, 71 nt, Homo sapiens
aacaugagauacuugguuucuguuucugcauugguuugcuuaggagaguggauuccagcuguauccauguu

SEQ ID NO: 2247712 - RNA, 67 nt, Homo sapiens
aaacuauguuuuguguauguuuucccuaguguguggcacacaguaggugcacaguaaauauauguuu

SEQ ID NO: 2247713 - RNA, 58 nt, Homo sapiens
ucaaugugaugugucacaugaacccaauuagggacaaaaaugauaucaucacaauuga

SEQ ID NO: 2247714 - RNA, 73 nt, Homo sapiens
caggagacucauggcucuuguuuacucccagucaacagcuuuggggaugacgaagagcuguccacaucuucug

SEQ ID NO: 2247715 - RNA, 78 nt, Homo sapiens
uggcuucuaaacaaagagguaauaacaaagcuucucauuguguugcaaauuaagugaggugccuuuuauuagaaguua

SEQ ID NO: 2247716 - RNA, 61 nt, Homo sapiens
gggaccagcucagaaccuugcacaacuauagcaaugacgagaugguguuuggcuugguccc

SEQ ID NO: 2247717 - RNA, 88 nt, Homo sapiens
cagaaagggugcggccuggcugacagcuuaauuccagcuuuacgaaacccugaguagagaauucagcuaaggugagcccagauuucug

SEQ ID NO: 2247718 - RNA, 75 nt, Homo sapiens
uucucucucaguauuucugggguugucuguuuugaaucaauggucaugucaucccucagaagugcagggagagaa

SEQ ID NO: 2247719 - RNA, 56 nt, Homo sapiens
uacagucacauuccugaccauacaucgugaaaauuguguguguguguguguuugug

SEQ ID NO: 2247720 - RNA, 63 nt, Homo sapiens
auaucugcauugccauuuaugugggauaaagcuuguuuacccuuaaagguauuguguaggugu

SEQ ID NO: 2247721 - RNA, 88 nt, Homo sapiens
ugcagggugauuccaugaugguaguucagucaauguauucugcuacuguauuacaaguuugauuggauuauauccaaguccccuugca

SEQ ID NO: 2247722 - RNA, 67 nt, Homo sapiens
acauauuugucacuauguggcuaauauaugccaagccuguguuagucagucauuagggauacaaugu

SEQ ID NO: 2247723 - RNA, 83 nt, Homo sapiens
aagaggcuuucuaaauguguaauugcaggcaaguaacaacacuugagucuccuucauugcaucuuuaagagagagaaccucuu

SEQ ID NO: 2247724 - RNA, 68 nt, Homo sapiens
cagcauuggauuuucugauccuguaaacauaaauaacauuagaaaucaaggucagcaaagucuagcug

SEQ ID NO: 2247725 - RNA, 91 nt, Homo sapiens
agugaaugcaguggaggauaagggaagcagcuuuuauugaucuuguuauuuauaugaaaacaugauuugccuguuuaccacaguguucauu

SEQ ID NO: 2247726 - RNA, 66 nt, Homo sapiens
agcauuuggguuuuacaucaggcuaaggaaaaucuuccauaucccagauuaaaaaucuagguugcu

SEQ ID NO: 2247727 - RNA, 77 nt, Homo sapiens
ucucugucuuccuuuguuacaguuggcucugucaccaucgucuccauaugacaggugagcaaacagaggaucagaga

SEQ ID NO: 2247728 - RNA, 57 nt, Homo sapiens
ugcaugggacauagccaaguacgaggaucgauucugugcauuggaugucucccugca

SEQ ID NO: 2247729 - RNA, 74 nt, Homo sapiens
gauuacugaguaaaagugugagugcagaauuuauaaaguucuuaguggcaccacuuuuuuuuaacucagugauc

SEQ ID NO: 2247730 - RNA, 92 nt, Homo sapiens
cuuccacuuuccuggaggacugaggccucugagcugaauguaaauagcauuugacacugagagccucaguaauaccuuaaguuaucugggag

SEQ ID NO: 2247731 - RNA, 89 nt, Homo sapiens
ggaguuuugcucuuguugccuaggcuggagugcaguggcacaaucuuggcucacugcaaccuccaccucccggguucaagugauuaucc

SEQ ID NO: 2247732 - RNA, 56 nt, Homo sapiens
gccccguuacagccucagugccugcccaaggaucaggcuugagaaaugagcguggc

SEQ ID NO: 2247733 - RNA, 61 nt, Homo sapiens
ugggaggaaggugcuaggccuugaguagcaggaagacaaugggucuggcuucuuuguucca

SEQ ID NO: 2247734 - RNA, 92 nt, Homo sapiens
uugauguauaaguuuauggcauuguuggugaugauauuugaugguuuuacaaguguguccuuaucuccaaacaaucaaguuuuauauauuaa

SEQ ID NO: 2247735 - RNA, 74 nt, Homo sapiens
uggagccccugggaggaagggcggucgugaucuccauggaucaguggacuuagucuuucccccugcuggcucug

SEQ ID NO: 2247736 - RNA, 79 nt, Homo sapiens
cugagaaaguccauaaaccacuuaagggaaguacauccuuuguaucauucuugguuuaucgcuuuaaaauugcauucag

SEQ ID NO: 2247737 - RNA, 64 nt, Homo sapiens
uauauuaugcauggucugaagucaaccucuaaagagagguugucuaauugagcguuguaguaug

SEQ ID NO: 2247738 - RNA, 62 nt, Homo sapiens
guuuauucuucaagaaccuagcugaccaagugguacacaugauaagugcuugaugaaugaac

SEQ ID NO: 2247739 - RNA, 76 nt, Homo sapiens
aguagaugauuguugagauggauagacauagcauuuaacuugaagaugcucuugucaauuuacuucuaccacuacu

SEQ ID NO: 2247740 - RNA, 60 nt, Homo sapiens
cugguucuuauugccuuauauauuuuuuugaauggaaugagaacugucaaugagagcuag

SEQ ID NO: 2247741 - RNA, 123 nt, Homo sapiens
ggaggguauugugacauaucucugguaguaucacuuagguuaugccgcucuucuacuuggucccugccaaccuggagagugacauauuucuaggccaggcacacagaugaugguacucuuucc

SEQ ID NO: 2247742 - RNA, 77 nt, Homo sapiens
ggguugaaugagagcccauaccaugguucaaugcauagcuucaauuccugccaacauggcgcuccauucuuaggccc

SEQ ID NO: 2247743 - RNA, 73 nt, Homo sapiens
auuguuuucugacuagacaagcaguguacaguaauuguuuuguacaacuuuuugcuuuuuuggcacugacaau

SEQ ID NO: 2247744 - RNA, 67 nt, Homo sapiens
gaggcagguuuucaccugaagucaggaguucaagaccagcuugaccaauauggugaaacccugucuc

SEQ ID NO: 2247745 - RNA, 78 nt, Homo sapiens
gguuauuuuuaugcagacauuguuccaaccacaacgacuguuuucgaaggugggugguauuuguuugguggaaggauc

SEQ ID NO: 2247746 - RNA, 59 nt, Homo sapiens
gugagauggguuuuuugaagacagcauuccuuuggguguugcuucuuuauccagcuugc

SEQ ID NO: 2247747 - RNA, 74 nt, Homo sapiens
ucuuucccuuuuuucugugcccugcuagcuggaaaucuuccauuugguuauguaucgaaacuaccagcggaaga

SEQ ID NO: 2247748 - RNA, 59 nt, Homo sapiens
uuuguaagaacuauaaauugcuuggguucacucucuuccuuguauguaguacuuauaaa

SEQ ID NO: 2247749 - RNA, 64 nt, Homo sapiens
gaagcagugaggucaagagcuuggcuaucuuucacugacaccuggcucuguggucucagguuuc

SEQ ID NO: 2247750 - RNA, 83 nt, Homo sapiens
guuuucuacucagguagcuagauuaugugagacucaucagagcuuuaaaacugauaagcauagucuagcuaccuuugggaagc

SEQ ID NO: 2247751 - RNA, 58 nt, Homo sapiens
ucaaaucaucuuuuccaaagcucauggguuagguaaggguuuugaaaaggcaguuuga

SEQ ID NO: 2247752 - RNA, 57 nt, Homo sapiens
ccagauuagguagaaucuugaagccauugaagcaaggacuuuggguuuuaccuuugg

SEQ ID NO: 2247753 - RNA, 80 nt, Homo sapiens
cucacaguugcacauggcuggggaggccucacaaucauggcagaaggcuaaaggcacuuccuacauggcggcugcaagag

SEQ ID NO: 2247754 - RNA, 71 nt, Homo sapiens
ggccuucucaauggaugugggaccagugcacacagaugccacccuacaagugaccauugcccuagagggcc

SEQ ID NO: 2247755 - RNA, 68 nt, Homo sapiens
uaugauguaggccauggguuucucauaaacggucuuuauuauguugaggaacuuuccuucuauacaua

SEQ ID NO: 2247756 - RNA, 98 nt, Homo sapiens
gcuuagcuauccagaaaacauaaaauguggacaucggaggaaaaaagaaccauucuugggguuuccagguggccaacauuuuacuguguggcauaggc

SEQ ID NO: 2247757 - RNA, 55 nt, Homo sapiens
gucuuuguuauuaugaaucaacauacaugugcauguuuguuuauaguacaaggau

SEQ ID NO: 2247758 - RNA, 118 nt, Homo sapiens
aaguugcuucuacauuuuugaguaucuuuucagcagugccccacucuacugguaccaauuuacuguauuagucuguuuucacacugcugaugaagacauaccugagacugggcaauuu

SEQ ID NO: 2247759 - RNA, 57 nt, Homo sapiens
aaaugggagugagcuacuguuccagccugaaaggaagagagcuuuaacuacccauuu

SEQ ID NO: 2247760 - RNA, 74 nt, Homo sapiens
uaguuucaaagaguagacgcuaaacagguuucuuugcugcuggaacccuguaggacuauucuaauccuaaacua

SEQ ID NO: 2247761 - RNA, 68 nt, Homo sapiens
aagggacccuggguacaguuaccaacugccucucccccagaugcuaguagcugcacccaggccuccuu

SEQ ID NO: 2247762 - RNA, 76 nt, Homo sapiens
ucacuugagcccagaaguuggaggcugcagugagcuaugaucaugucacugcacuccagcuuuggugaaagaguga

SEQ ID NO: 2247763 - RNA, 82 nt, Homo sapiens
uaaagauuagagaugaguuagguaauaauaaauaugguauuuuuucuagauuugguagcauuuaacagguuucucagcuuua

SEQ ID NO: 2247764 - RNA, 93 nt, Homo sapiens
gagggagaagacagggauuagguagggaauauggaggugcuucugggguggcuggcaaaguucuauuucuuauccuagguaguauuuaccuuc

SEQ ID NO: 2247765 - RNA, 108 nt, Homo sapiens
aacugcugaaaaaaauuguacucaucgcuauuguucuuacaugcugucaucugcaaaaauaggauguagcuuugagggaacaaaugaugagaccuuuucacuccaguu

SEQ ID NO: 2247766 - RNA, 61 nt, Homo sapiens
gcaucuguuuauaggcucuccacaaggguagcauuccauucccagagcuaugaacauaugc

SEQ ID NO: 2247767 - RNA, 95 nt, Homo sapiens
gccucccuuuuaaaauaaugaaacaaacauuguuuaaguuaaauuguuacuugguuccuccccacaguguuacuugauaguguauguuacgaggu

SEQ ID NO: 2247768 - RNA, 77 nt, Homo sapiens
uucaaaucauuaggcauuuuucugauaaacuagguucuugggugccuucuaucggcaagaaugcguacuuauuugaa

SEQ ID NO: 2247769 - RNA, 84 nt, Homo sapiens
cgcauggcucuccacucaaggugcugagacaggagcccugggaacuacgggcucuuccccgcagggccucaaguggacugugug

SEQ ID NO: 2247770 - RNA, 57 nt, Homo sapiens
auuucuaugguuuaagucaccaagauugugauaauuugugauggaagccacaggaau

SEQ ID NO: 2247771 - RNA, 131 nt, Homo sapiens
gcuagucacuggggcaaagaugacuaaaacacuuuuccugcccucgaggagcucacagucuaguaugucucauccccuacuagacugaagcuccuugaggacagggauggucauacucaccucgguguugc

SEQ ID NO: 2247772 - RNA, 59 nt, Homo sapiens
aagucaaggagagaagcuucaggagaaaccaacccugcuggcacuuugaucuuggacuu

SEQ ID NO: 2247773 - RNA, 61 nt, Homo sapiens
uuucuauccuguauacuuucaaauucagaaaaaaaggaaagugacaguuaagggauagaag

SEQ ID NO: 2247774 - RNA, 93 nt, Homo sapiens
ccaguugcacacuggcauuuucuugcugcaagcuuuuuuaaauuucugaacucaaggcaguggcagaagaugucagucaccucugauaacugg

SEQ ID NO: 2247775 - RNA, 58 nt, Homo sapiens
uuuuaugcagagcacagagaguuaggagagagaacagcacuuugugcuccacaaagga

SEQ ID NO: 2247776 - RNA, 73 nt, Homo sapiens
cagauuuagaccugugguuucagaaaaauuuuuggagcaaauuuaaacauguuuggcacuauagguaaauuug

SEQ ID NO: 2247777 - RNA, 56 nt, Homo sapiens
cugcuggucuuuaaggucuaggccaaaagcuaagcaaagacgguaaggcccagcag

SEQ ID NO: 2247778 - RNA, 127 nt, Homo sapiens
agggcggggcccucauggagaaacucugcuaggguagugcagaagggaaauguggggucagagccuccacagagagucccuacugggguacugccuaguggagcugugagaagagggccacuguccu

SEQ ID NO: 2247779 - RNA, 60 nt, Homo sapiens
acgggaagaaguaaugaaggucuucccacauucaacacauucauaaggcuucucuccugu

SEQ ID NO: 2247780 - RNA, 61 nt, Homo sapiens
ucucuuugucucuaagaagugaugagaaggggcugauaucacagaacuuugagcagagagg

SEQ ID NO: 2247781 - RNA, 59 nt, Homo sapiens
gguuuuuguucugcuuugccuugugauauuuuucuugagugugaggaagaauuagaauc

SEQ ID NO: 2247782 - RNA, 73 nt, Homo sapiens
auugacacugauuuuucuuuaaaaugugggacacaagcauuucucaagucuaaaaagagaagucauuguuagu

SEQ ID NO: 2247783 - RNA, 94 nt, Homo sapiens
gagaguaaaauucuacuguagagauuaacucaugguuuuaccgucaggaaaacugguaguuuugaguuaaucucuacgauagaauuucuuucuc

SEQ ID NO: 2247784 - RNA, 103 nt, Homo sapiens
uucuuuaugggugguuuuaaauuauugauucaagcucuucacugguuaugggccuaugaagacucauacuugaaucaguuucagcaguuuguguuuccaggaa

SEQ ID NO: 2247785 - RNA, 96 nt, Homo sapiens
ggggugauaucaccuuccacagggaucuccuaacuguacagagggcuuagcacacugucuggcacucagaggccuugcuggaucgugauccgcccc

SEQ ID NO: 2247786 - RNA, 99 nt, Homo sapiens
agaagccaaugucggaaaaugaauccuguagauucuaauuccugcacugugugaggacuacuggugaauuauuuuccgccacaauuugcauuuucuucu

SEQ ID NO: 2247787 - RNA, 128 nt, Homo sapiens
caucucuauaauaaaaaggaaaaagaggaauccccuuuguagguuucauaguuuauacugauauuucugaugucgucucagagaauuagucacaauuauaggaacucagaaggcauuccguggagaug

SEQ ID NO: 2247788 - RNA, 129 nt, Homo sapiens
uggguagcaguccuaacacaaaggacuccacugagaaguguugaucuguuagaacagagcuggguacaugacaguguucuggcucaggucaacacuuccugguuccagcccuugguagggugcuuucca

SEQ ID NO: 2247789 - RNA, 61 nt, Homo sapiens
aaaugcugucugugagccucaugacccaagaugucaucuccuguagcgucacauagcauuu

SEQ ID NO: 2247790 - RNA, 61 nt, Homo sapiens
aggaaccugaugcucucacuguucuccacugccugaaacugucagcacaacucagguuccu

SEQ ID NO: 2247791 - RNA, 63 nt, Homo sapiens
uccaaguguaugcaugugugugugugugugugugugugugcgugucaugugcauacauuuggg

SEQ ID NO: 2247792 - RNA, 129 nt, Homo sapiens
cauguaacuuauuugugccuucaggaccugcucaagccugucauguauauaccacuuccauuugaugauggaaugcugcugugcaggacccaccuaauggcuagauaggucgaaagcacccaguucaug

SEQ ID NO: 2247793 - RNA, 55 nt, Homo sapiens
agcuggcuguagcugcaagucuuauuguccaggagaaacugcagcuguagcagcu

SEQ ID NO: 2247794 - RNA, 93 nt, Homo sapiens
ccauguacccagaaauauauuuagcaaagcaauuuacaccaucacuggcugauggauugugguuuucuaaguuggguuuuaagauguaaaugg

SEQ ID NO: 2247795 - RNA, 58 nt, Homo sapiens
ugagacugagucuugcccugucacccaggcuggagugcaguggcgugauuucggcuca

SEQ ID NO: 2247796 - RNA, 101 nt, Homo sapiens
caguggcucacaccuguaaucucaacacuuugggaggcugaggugggagacugcuugagccugggagguagagguugcagucagcugagaugacacuacug

SEQ ID NO: 2247797 - RNA, 62 nt, Homo sapiens
aucugguauuauuugccuuuuacugaaggacuuccuuuacuaugugcaaugaugcucaugau

SEQ ID NO: 2247798 - RNA, 77 nt, Homo sapiens
ugcgcguccgugugaagagaccaccaaacaggcuuuguaugagcaacauggcuguuuauuucacaugggugcaggcg

SEQ ID NO: 2247799 - RNA, 58 nt, Homo sapiens
guagaccauuuaucuggggaguuuuaucuaugggaacaauccagaugauauggauuac

SEQ ID NO: 2247800 - RNA, 79 nt, Homo sapiens
ucugaggaaaauuaugagacaguucccuuuaucuuuaguacaacugaaguaaaagaaugacuuuuugauaauucccaga

SEQ ID NO: 2247801 - RNA, 77 nt, Homo sapiens
guguaagguuucuucuugugcuuaauggguauaagguuucuucuugugcuuaaugaguguaagguuucuucuugugc

SEQ ID NO: 2247802 - RNA, 83 nt, Homo sapiens
uuggauagaaacauuucauagaugagcaccugucaauggaucacacuuugaguagaacuagucuagagcuuguuuuucuccaa

SEQ ID NO: 2247803 - RNA, 70 nt, Homo sapiens
gaucauaaaugauauggucacccuuaugaaugacuggugaucuuucauaaggguggccauauaaaagauc

SEQ ID NO: 2247804 - RNA, 56 nt, Homo sapiens
cagauggucuuaaggcagccuucugggugcacacaaggcaucuuauagaccacuug

SEQ ID NO: 2247805 - RNA, 122 nt, Homo sapiens
ucaugcucaguaagucagcauuuuauauaagauuaacauagaguagcuaccuguagagauauuuaaguuuuuacucguagcuaucuguuuaggaacaaaaggaaaggaggcuuccugcauga

SEQ ID NO: 2247806 - RNA, 77 nt, Homo sapiens
ggacugaggccagguugccaaacugcggagagugggguuggagggcuuucauggcaguuuggggccugcuugugucc

SEQ ID NO: 2247807 - RNA, 86 nt, Homo sapiens
ucuggccauuuaaagccauugucaaguuuguacuggggccaagcgguguugcagaagaagauaaggcauuuagguuuuaggucggg

SEQ ID NO: 2247808 - RNA, 66 nt, Homo sapiens
cgcuugaaccugggaggcagagguugcagugagccaagauugcaccauuacacuccaggcugggug

SEQ ID NO: 2247809 - RNA, 77 nt, Homo sapiens
aacauacuauaaacuacuacuuucugacaucuuuaaugucucuuuuguuguaggauguugacaguagaaagaauguu

SEQ ID NO: 2247810 - RNA, 93 nt, Homo sapiens
cugagugaccuauaugagaugaguugcuggcucugauccauucucucaugauuagaugaccacaacucaugaucuguauugguggguacucag

SEQ ID NO: 2247811 - RNA, 55 nt, Homo sapiens
uagcagugucauuuucuggugagggcugcugucuacauaaaaaugaugcugucug

SEQ ID NO: 2247812 - RNA, 93 nt, Homo sapiens
cagcacagcugaggagcagccaacucuguaccauggggccugcaggaaagccucugagcugcuguggcagauuggauucuccuaagcuggcug

SEQ ID NO: 2247813 - RNA, 66 nt, Homo sapiens
cuuugaaacuuauuguuaacuuucugucucguugaucugucuaauguugacaguggguuguuaaag

SEQ ID NO: 2247814 - RNA, 79 nt, Homo sapiens
gagaacugggauggaggagaauuagaggauggugugguguuucccaagacauccccugaucuugcuaucccagcaucuc

SEQ ID NO: 2247815 - RNA, 64 nt, Homo sapiens
uucuuuacggccaguucuuauuggaauuaaaauucaaguauuaguuccuacuggcuguaaagaa

SEQ ID NO: 2247816 - RNA, 83 nt, Homo sapiens
uauuagguuggugcauaaguaauugugguuuuugccaugacuuuuauggcaaaaccugcaauuacuuuugcaccaacuuaaua

SEQ ID NO: 2247817 - RNA, 108 nt, Homo sapiens
uguuggcccuuccuggguccugaguuugcagaccuuuggacuggaacuauaccauuggcucuccugagucuccagccugcugguugcagaucuuaggauuugucagca

SEQ ID NO: 2247818 - RNA, 68 nt, Homo sapiens
uguuuuuaaguguggaaaggaucuacucucuugcaugggaauauggcaucuguucuacacauaaagca

SEQ ID NO: 2247819 - RNA, 92 nt, Homo sapiens
gcaugcaggcuuaauacaugggugauagguucauaggugcagcaaaccaccauugcacacauuuaccuauguaaaaaaccugcacauccugc

SEQ ID NO: 2247820 - RNA, 126 nt, Homo sapiens
ggcucuuuuuugguuccaaauggguuuagaauuguuuuuuccucuuuugcuaauucugugaaaaauguaguuaguaguuugauaggaauagcauugaaucugucaauuguuuugccaggcaaggcc

SEQ ID NO: 2247821 - RNA, 64 nt, Homo sapiens
accgauaacuugaaaagcuuggacuagaaugucaugaagucuguccagcuuugagaguuguggu

SEQ ID NO: 2247822 - RNA, 74 nt, Homo sapiens
augucggaggaugcacuuugucaguaaguuaggcauucagucuucacugucaacacaaaugcauucugugacau

SEQ ID NO: 2247823 - RNA, 84 nt, Homo sapiens
cugcuccuccauugguccacugugaaauugggacaaaagauaucuuauuuuuuaggauucacauggauucaugauggagagcag

SEQ ID NO: 2247824 - RNA, 76 nt, Homo sapiens
aguuuaccuacauaguuaaguaacaaacucaagaaaugaauuuggcaauuugacuguauaggccauugaaugaacu

SEQ ID NO: 2247825 - RNA, 97 nt, Homo sapiens
ggguauucacacugauauucuuggguaagucauuaaaauuagucaacuauuucugugucuucacccacaaaaggagacgugugagaagugaauacuu

SEQ ID NO: 2247826 - RNA, 62 nt, Homo sapiens
uaagagcuaggauuuuaaaucagccaauguugauaaaguugauuguaaaauguugguacuua

SEQ ID NO: 2247827 - RNA, 57 nt, Homo sapiens
uugacagagcuaggucaacucugcuucacaggguguugguugacacuggcucuucag

SEQ ID NO: 2247828 - RNA, 87 nt, Homo sapiens
agccuuugcaacauuuuacccauuagagaauuuaagagaaauaaacauuuuuuacaguuuuuugggguuuuuguuuguucguuugcu

SEQ ID NO: 2247829 - RNA, 72 nt, Homo sapiens
gucauugguuuauagauggggaaacagagacacagaauaguuuaguaccuuuuccuaccuagaaucaaagac

SEQ ID NO: 2247830 - RNA, 78 nt, Homo sapiens
uggguaucucugacacuucugcagaauugaauguccaucuggacaaauuaaugaccccaugaguguuugaccugccua

SEQ ID NO: 2247831 - RNA, 79 nt, Homo sapiens
cuaugaaaucuugggcaaauuauguaucucucagccucaguuuucuuguguguugaagauaauaauaccuaggucaugg

SEQ ID NO: 2247832 - RNA, 94 nt, Homo sapiens
gaagagcaggcccuggucagaguauucuccaauugacgucaaucaguucuccacuugauugaccuggagaguacuuugacagggccugcucuuc

SEQ ID NO: 2247833 - RNA, 70 nt, Homo sapiens
ucaucacuggucaugagagaaguacaaaucaaaaccacaaugagauacuaucacaugccaguuagaauga

SEQ ID NO: 2247834 - RNA, 83 nt, Homo sapiens
uuuucuauuccuguguaaguuuagguaagauucguguuguucuuuggaaaugccaucuuguccugagguuuuauuguggaaga

SEQ ID NO: 2247835 - RNA, 66 nt, Homo sapiens
cuuggaauacucaaaagguugggauauuuuauucauauuucuuuccaaauucuaugauauuccagg

SEQ ID NO: 2247836 - RNA, 63 nt, Homo sapiens
gaaaacaacuaauguugccuuaaguccucuuucuuucaaggaaagcaucauuaguugcuuuuc

SEQ ID NO: 2247837 - RNA, 68 nt, Homo sapiens
uuugugguauguagcaaaagaggugcuuagagugaaauuuguagcacuggaugcacauauuagacaaa

SEQ ID NO: 2247838 - RNA, 56 nt, Homo sapiens
agugaggucuacuucuugaaccuuaaaagaaaguggggauuagagguagacucauu

SEQ ID NO: 2247839 - RNA, 60 nt, Homo sapiens
caaagcuaaaguuagaaauccgacucuuggaagauuuuaagacacuaacuuuaugcuuug

SEQ ID NO: 2247840 - RNA, 55 nt, Homo sapiens
cagcccaaaucaggauucacaaggcugucugcugccaucugaauguuuguggcug

SEQ ID NO: 2247841 - RNA, 73 nt, Homo sapiens
caccaucucagagaaaauuacuaagauuuggacauaguuccuuucaucuucuugguuuuucuuuguaugugug

SEQ ID NO: 2247842 - RNA, 68 nt, Homo sapiens
aacuugaaaacagcuagcaugcguaacuuucuuuuccccaaaagagaguagaguguaguugaaaaguu

SEQ ID NO: 2247843 - RNA, 78 nt, Homo sapiens
ugguuuuuguuguugguucuguuuauaugcuggauuacauuuauugauuugcauauguugaaccagccuugcauccca

SEQ ID NO: 2247844 - RNA, 78 nt, Homo sapiens
ugguuuuugucguugguucuguuuauaugcuggauuacauuuauugauuugcauauguugaaccagccuugcauucca

SEQ ID NO: 2247845 - RNA, 83 nt, Homo sapiens
uguuacuguccaaucuaauucugcaacgcugagaccucaugggauggguugcaugguggaacuuggagcuggcacggauaaua

SEQ ID NO: 2247846 - RNA, 61 nt, Homo sapiens
aauaaaauauccuuauucuuacaaaauccaagcaggaaguggcagugggagauauuuuauu

SEQ ID NO: 2247847 - RNA, 89 nt, Homo sapiens
gggcuggaaagugaaagccaagaguggugguucugaaacuuuuacuuuguaauuucuauccaucauucucucuggcucuucugaggccc

SEQ ID NO: 2247848 - RNA, 61 nt, Homo sapiens
ucuccuuuguuuaguugaauuguauuguucucuucaaaacuaacuuggcuaaauaaagaga

SEQ ID NO: 2247849 - RNA, 60 nt, Homo sapiens
uuggcacuagcacuaucuauugcaugcaaaaguuuugcucaaaagaaguguugauguugg

SEQ ID NO: 2247850 - RNA, 75 nt, Homo sapiens
ucuaugucagacaagguaaacuagggugacagaaaguagaucugugccugagguuaacauuguugguuacauaga

SEQ ID NO: 2247851 - RNA, 64 nt, Homo sapiens
uuugguuugccaguauucuacugaggauuuucacauugacguucaucagggauauuggccugaa

SEQ ID NO: 2247852 - RNA, 62 nt, Homo sapiens
uucucugguggaagcagggggcaaaaaccaauggauguugcucacugacccagcuagcagaa

SEQ ID NO: 2247853 - RNA, 67 nt, Homo sapiens
uugaagagguagucugucccuuagcagagcucgaacgcugugcugggagauccacugcucucuucag

SEQ ID NO: 2247854 - RNA, 88 nt, Homo sapiens
ggagaaucgcuugaacccuggaggcggagguugcagugagccgagauggcaccauugcacuccagccugggggacaaagcaagacucc

SEQ ID NO: 2247855 - RNA, 57 nt, Homo sapiens
ccugaguaccugccagugagugaacucuccagagcuuucaucuggccguauuccagg

SEQ ID NO: 2247856 - RNA, 73 nt, Homo sapiens
guagaacuuucaggaguuuccuuuaguuucuggggccuugguucuugaacaaagagauuccauuaucuucuac

SEQ ID NO: 2247857 - RNA, 76 nt, Homo sapiens
uauccuagugggguuucagucaccagcaaagaaaauccuaauuaguacauuuguauaugagaaauuccacaggaug

SEQ ID NO: 2247858 - RNA, 81 nt, Homo sapiens
auuugucuuugaaucauuggguugauucaagauucuggcucuaucuucaguagcucccaugaugcacuaaaaaaggcaaau

SEQ ID NO: 2247859 - RNA, 58 nt, Homo sapiens
aguaggcuugcucguugccaauuauccucuugaaaacuggucuuaugcaagcacuauu

SEQ ID NO: 2247860 - RNA, 77 nt, Homo sapiens
aggaggaugaguucauuugggagaucauuuauagagguucuauauugacuugauucccucaagugccuuauguuuuu

SEQ ID NO: 2247861 - RNA, 88 nt, Homo sapiens
gcuuauaaccugggaaggggaaaguugagcaaauauuauggaagaaaaggaaauauagcacugcaauauuucccugacagcugugagc

SEQ ID NO: 2247862 - RNA, 57 nt, Homo sapiens
gugcuauguuauccagcaagaugacccugcaaagucaaugcuguguauucaaggcac

SEQ ID NO: 2247863 - RNA, 91 nt, Homo sapiens
uuggcuuuuuuuuuuuugguugcauucacauauuucaucuagugguauauuucuuaauguacaggagguaugaagucaacuaguuguccaa

SEQ ID NO: 2247864 - RNA, 109 nt, Homo sapiens
ucccuggugugaaacacacuucaucaugguggauuaucuuuuugauaugcuguuggauucagucagcuaguaauuuauugaagauuuuugcaucuguguucaucaggga

SEQ ID NO: 2247865 - RNA, 98 nt, Homo sapiens
uuugucugucuuuugccucuagauauaagccaauaaguacagagaccuagcugcuuuuucuugguuguauuuagacuuuuucaaagugaaucagcgaa

SEQ ID NO: 2247866 - RNA, 76 nt, Homo sapiens
cggaauaauuuuuaugggucuuggaaugcaauauaaacuuaaaauauuguguuugcaaguccuauuggcaugaccg

SEQ ID NO: 2247867 - RNA, 70 nt, Homo sapiens
uguuauguuuuagagguuucaaaauuauucaaaugcuuuuguauguuuugaauauuuucauggcaugaca

SEQ ID NO: 2247868 - RNA, 77 nt, Homo sapiens
augauggagaucacuguuuauauucucuguaaaguuuuaauuaugaaaaaagauuugugaagguggucuugaguugu

SEQ ID NO: 2247869 - RNA, 129 nt, Homo sapiens
agagagccuauaaauggacaugcaaguaggagagauauugcuaaauucuuuuccuagcaaggaauauuaauauuaagacccugggaaaagaauugcaauccuggggggcggucuauaaaugggcgcucu

SEQ ID NO: 2247870 - RNA, 75 nt, Homo sapiens
uaagguugaaagcuacaggaaaguauuuucacuaacaaagggugaaaauaauguaaguauuuuuaaaaacccuug

SEQ ID NO: 2247871 - RNA, 81 nt, Homo sapiens
ucaucaaguuagagaguaucagagcgaggauuagauccaagacaugguucaauuucuggcucgauucucugaccgggcuga

SEQ ID NO: 2247872 - RNA, 88 nt, Homo sapiens
uuugauuagcuuaauacucuucuaaguaguccaaggguuaaagaauaaaucaaaagggcacuaagaaaguauuuuggauaaaauuaaa

SEQ ID NO: 2247873 - RNA, 56 nt, Homo sapiens
uuggagagagaggacucccggcccuacccaggccucgugggaguuucugucuccaa

SEQ ID NO: 2247874 - RNA, 102 nt, Homo sapiens
gcacgugaaccugcucugaccccaugccaguguccagaguggguugagcccucccuggaguagacaccgcuuaaggacaaagcaggagacaggcuggcgugc

SEQ ID NO: 2247875 - RNA, 116 nt, Homo sapiens
ggaagcugaggugggaggaacgcuugagcccgggaguuggagguugcagugagcugagauuucaccacugcacuccagcuugggugacagagcgagaccuugcccccucaccuucc

SEQ ID NO: 2247876 - RNA, 88 nt, Homo sapiens
ggagucucgcuguguugccuaggcuggagugcaguggcaugaucucggcucacugcaaccucugccucccagguucaagcgauucucc

SEQ ID NO: 2247877 - RNA, 64 nt, Homo sapiens
gcugugucauugcacuuggaaagcaaucauuuaaagauaguuuucaggcaggugaaagaccagc

SEQ ID NO: 2247878 - RNA, 65 nt, Homo sapiens
augagauuugggaggggucagagguggaauaauaugguuuggcuuuguccccacccaaaucucau

SEQ ID NO: 2247879 - RNA, 103 nt, Homo sapiens
gcugggcaauguuuuaagugcuuucuguauauuuauuuaacucucauaacaaccuaugagguagguaugacuaucacagagaggcauagagagguuaacuagc

SEQ ID NO: 2247880 - RNA, 62 nt, Homo sapiens
cuggaugucaaagaggaaaacuggauguccuucuccagaagcggucaucaaguuccuccuag

SEQ ID NO: 2247881 - RNA, 67 nt, Homo sapiens
ugugugugacugagucuugcuuugucucccaagcuggaguacaguggugcgaucucggcucacugca

SEQ ID NO: 2247882 - RNA, 61 nt, Homo sapiens
gcaguaccagcucacgagucucgaacauuuaccuggugcugagaccugaucuugguacugc

SEQ ID NO: 2247883 - RNA, 66 nt, Homo sapiens
ggcugaugacaguaugacuccaaaaguuuuaaucaaaaaauuauuuugggaauuacuguuggugcc

SEQ ID NO: 2247884 - RNA, 75 nt, Homo sapiens
ucuuuuuggagucugauuuuuauguugcucauuuacuuaggaaucgagaauuucuaguucagaacugcaaaaaga

SEQ ID NO: 2247885 - RNA, 55 nt, Homo sapiens
cuuugugcccuucugcccaucacccaccggcuuggucggcgaaggcggcacaaag

SEQ ID NO: 2247886 - RNA, 56 nt, Homo sapiens
cugcauugcuugcuuuugucagguuugucaaagaucagauaguuguagguaugugg

SEQ ID NO: 2247887 - RNA, 82 nt, Homo sapiens
ucagguaucucuauagcaaugugccccuccuugguaccaauuuuauuaggcuguucuugcauugcuauauggaaauacuuga

SEQ ID NO: 2247888 - RNA, 108 nt, Homo sapiens
ugugucgucucauggugggcugcuguccugaaaguguaucagacuugucaaauugguucaaauuaaauugacauggugcucuuucaggcaucaccacauuauuauaca

SEQ ID NO: 2247889 - RNA, 86 nt, Homo sapiens
gugcuuagcaggaugccuggaauauaguaugcaguuaacaaauauuagcuguugcuauuauuccgagaaugaaaccucagaagcau

SEQ ID NO: 2247890 - RNA, 61 nt, Homo sapiens
agaaauuaaacggcucugcugugcucuuccaaucuauugagaacagcugguuuugguuucu

SEQ ID NO: 2247891 - RNA, 86 nt, Homo sapiens
gagaauugcuugaacccaggaggcagauguugcgguaagcugagaugucacuacuguacuccagccugggugacacggcaagacuc

SEQ ID NO: 2247892 - RNA, 91 nt, Homo sapiens
ggcugugaaccaggucaucaggacgggucaucugcuuccccacgggugugguugggcugcagggaccuuguugcugagacuaggaacagcu

SEQ ID NO: 2247893 - RNA, 82 nt, Homo sapiens
auuagauuugugcaaaaguaauugcgguuuuuaccaucaaaaggaauggcaaaaaccgcaauugcuuuuguaccaaccuaau

SEQ ID NO: 2247894 - RNA, 58 nt, Homo sapiens
cuccacuacagacucaucuacucaccugaggauuaugaggauuaugaguuuuauggag

SEQ ID NO: 2247895 - RNA, 109 nt, Homo sapiens
gggacagagagagaggaggagguuggcuugagaugaagcuagaagaaugggcaaacuucacuucucuuuguucauuuguaccccaaguuguauucaucccuuucugccc

SEQ ID NO: 2247896 - RNA, 56 nt, Homo sapiens
uccccaaacggguugugugagccccuugaggcguuuauccagcgcuguuuuggaga

SEQ ID NO: 2247897 - RNA, 96 nt, Homo sapiens
aggagaaucgcuugaacccaggaggcggagguugcagugagcugagguggcaccacugcacuccagccugagccuggaugacaaagugagacuccu

SEQ ID NO: 2247898 - RNA, 108 nt, Homo sapiens
ucuguaugguauuuugaaugaaucauauuagugucaugaaguuuugaaugaaauuuucugaauuuuacacugacuucuguauuaguguagauuacugaaauacauaga

SEQ ID NO: 2247899 - RNA, 70 nt, Homo sapiens
gcaacacauugcaaaagaugauggugacaguuugagcaguaaaaaccaucagguuguagaauguguuugc

SEQ ID NO: 2247900 - RNA, 63 nt, Homo sapiens
agggccaugucucugaguaggcaaggagaauagaaucuauugcacaugaggagacauuguccu

SEQ ID NO: 2247901 - RNA, 64 nt, Homo sapiens
ccugaauccuguucucaccucaguuaacuagcuucucauuaccugggugcugaugggcuuuagg

SEQ ID NO: 2247902 - RNA, 85 nt, Homo sapiens
accggaagucaagugguagaaucaucuuggagagauucuauauccguuucuaagggaagguaaucauuacuugaucaauuuuggu

SEQ ID NO: 2247903 - RNA, 115 nt, Homo sapiens
gaaauaagggaaaaaauccguaaaauguucaaaguuggaggacaaacuguuuaguuuuaauauuuuuaguguauuuaucuuuggaauuuguuuuaugucuuuuuuuuuuuuuuuu

SEQ ID NO: 2247904 - RNA, 99 nt, Homo sapiens
ugagacagggucucacuuugucacccaggcuagagugcaguggugcaaacacagcuuacugcacuugaccuccugggcccaagugauccuccugccuca

SEQ ID NO: 2247905 - RNA, 66 nt, Homo sapiens
uuuucccugugggaguaggaaaguucaucugcacauagcauguuuauuuucauuuccaggggagga

SEQ ID NO: 2247906 - RNA, 70 nt, Homo sapiens
cugggcuauguaggaguggaguuuucaacacacaauuuucaaauggguaauugcacuaagcauaguccag

SEQ ID NO: 2247907 - RNA, 55 nt, Homo sapiens
ucugguucgugccacggcccugacuugauacaggcagguagugucugaagccaga

SEQ ID NO: 2247908 - RNA, 64 nt, Homo sapiens
gugcccaguuaggcuuuuuaaccaguuguuccaaaaaugaacuguuccaagccugcuugggugc

SEQ ID NO: 2247909 - RNA, 102 nt, Homo sapiens
ccagucuuggguaugucuuuaucaguagcaugaaaacagacuaauacaguaaauugguacuaguagagugggauguugcuggaaagauacccaaaaaucugg

SEQ ID NO: 2247910 - RNA, 82 nt, Homo sapiens
acucauuccuacuuauagucagugucuuugcagcucagaagggauuucugggcaugcauagggccuguaugguagggugggu

SEQ ID NO: 2247911 - RNA, 68 nt, Homo sapiens
uguaaucauccagucccaaauaugggaaacaaugaaaaucacaacuuccaugggacggaaugaauaca

SEQ ID NO: 2247912 - RNA, 87 nt, Homo sapiens
acucaucacacguuaucucgugguguccuaggugauuuugaauggucguucucgcugggaaccagagguaaagucuguguguugagu

SEQ ID NO: 2247913 - RNA, 73 nt, Homo sapiens
guuagggaggagucccucuuuuucuguuguuuggaauaguuucagaaggaaugguaccagcuccucuuuguac

SEQ ID NO: 2247914 - RNA, 61 nt, Homo sapiens
gcugggaucaguucuagucagaagcuccaaggagagcuuuuggguaacaugaucacucagu

SEQ ID NO: 2247915 - RNA, 67 nt, Homo sapiens
uggauuaagugcuugccagugcugguagagaagccugucaccucccaccacucucagcacuugucca

SEQ ID NO: 2247916 - RNA, 72 nt, Homo sapiens
ugccacauuuaauggagaguuucauuggugauauacuuaaugccauuauuuuccuauuauucuuugguggua

SEQ ID NO: 2247917 - RNA, 62 nt, Homo sapiens
agagacauugacuuuguuccagacuaucuuuacaaggauauuugcacagagauagugucucu

SEQ ID NO: 2247918 - RNA, 72 nt, Homo sapiens
agagaugauguugaauguucucaccacaaagaaaugauaaauguuugaggugauggauuugcaaauuacucu

SEQ ID NO: 2247919 - RNA, 86 nt, Homo sapiens
ucugccucucaaagugcugggauuuuaggcaugagccacugaacccggccaagucucaaaaacucagauaguuuacccaaaguaga

SEQ ID NO: 2247920 - RNA, 128 nt, Homo sapiens
ccugccccuggccucccaaagugcugggauuacaggcuugagccaccgugccuggccacaaagauggucuuuugccgggugcaguggcucaugccuguaaucccaguacuuugggaggccgaggcagg

SEQ ID NO: 2247921 - RNA, 70 nt, Homo sapiens
uugagauugggacagacagggagagugagauugggaaggagccacguucgguccccuuggcugcccucgg

SEQ ID NO: 2247922 - RNA, 62 nt, Homo sapiens
caaauugcuuguggaggauaauugauugucuuugccucgauugucuuugccucaagaguuug

SEQ ID NO: 2247923 - RNA, 75 nt, Homo sapiens
gagcagcuggugaaggcugaaaagugggucaggucccaggaggugcagguccguuuuuagcuuucauuagggcuu

SEQ ID NO: 2247924 - RNA, 77 nt, Homo sapiens
ugaaaauguguagcaggacaauaugggaucaggaaaccaaguguucugacucugcauugucugccccuccguguuca

SEQ ID NO: 2247925 - RNA, 75 nt, Homo sapiens
ggcuuuggacuguaauuuuauaggcaucauuggcaaugagaugauaaccuaugaaaaaauuacagcucaggaguu

SEQ ID NO: 2247926 - RNA, 65 nt, Homo sapiens
caucuguguucaggguauuaccuuaucacaugccauguagugucuguaaacucucagcauagaug

SEQ ID NO: 2247927 - RNA, 130 nt, Homo sapiens
cucugaauaucauaggauaguuuagucuuuagagggaaaaugucuguaugcgauuggaaacaaugucauguagaaauuguccauuauagugacagagcuauuaagaaaauguuacuuuauguauucagug

SEQ ID NO: 2247928 - RNA, 114 nt, Homo sapiens
cugugauauuaggaguuauaucucccuaggauauuacaaaucauaucacaggguguacacccacugugguauuagguguaguaucucccuaggauauaacaaauaauaucacag

SEQ ID NO: 2247929 - RNA, 111 nt, Homo sapiens
accuaggacuuugggacaauaaaagauaaagaugaguuuuagcaaauuuugcugaaucuugcacaauggaauuuaucuuugugaacucuuuuaaaaauucaacuucuaggu

SEQ ID NO: 2247930 - RNA, 58 nt, Homo sapiens
cuuggucuagcgguagcgucagugccuagggaaggcacccguuacuuagcagaccagg

SEQ ID NO: 2247931 - RNA, 83 nt, Homo sapiens
ucaaguacaacaaaugcugagccagaaauauuccaauauucuccuuguuggcaaguuucugucagcaaaguugcauaacuugg

SEQ ID NO: 2247932 - RNA, 66 nt, Homo sapiens
caguuaucaucagcagccauuuugcuuucuugcagcuaaauaaaauaauggcauguuggacaacug

SEQ ID NO: 2247933 - RNA, 123 nt, Homo sapiens
agaauuugcuaggccaugagggcucuacucucaugaaugaauuaaugucguuauuuccagaaugaauuaguugucgugagagugguuccauuauaaaaguaagcucucugguguacaccuucu

SEQ ID NO: 2247934 - RNA, 78 nt, Homo sapiens
uuuuugcccugcuuucuauuauauucuuauuuacuuuuaguggaugaugguuuuauuaauaggacccaauggcaaaaa

SEQ ID NO: 2247935 - RNA, 84 nt, Homo sapiens
agucagaguuuuggaauaacagugaugauaauaugcaaauaauuccugaacuaucuaucacagugauguuccagagacauggcu

SEQ ID NO: 2247936 - RNA, 101 nt, Homo sapiens
guggugguggaaucugcugagcuagaccauuuggcucccuggcuucagcccccuuuccaggggagugaaugguucugucucacuggcguuccuggcaccac

SEQ ID NO: 2247937 - RNA, 81 nt, Homo sapiens
guggcaguuucuuaguucauuuuucuugcuuagaacaccugaggcugggugauuuauaaggaaaauaaauuuauuuguuac

SEQ ID NO: 2247938 - RNA, 59 nt, Homo sapiens
gaguaacagcauaaauuugugacuuguuguacuggauaauucaggaguuaguugugcuc

SEQ ID NO: 2247939 - RNA, 78 nt, Homo sapiens
uuggauuuggguagcuaguauuuugcugaggauuuuugaaucuauguucaucaggguauuggucuguagcguuuuugg

SEQ ID NO: 2247940 - RNA, 62 nt, Homo sapiens
agucaagauggcaagguaaggcuaaugugcaucuagacauuguuuuacaggcuguuuugauu

SEQ ID NO: 2247941 - RNA, 92 nt, Homo sapiens
uuuggagcagaguguggaguaggaaggaaauguuaaaaaguauuaagaugugaaguuuaauccuuuuuuucuacaaacuuuucuguuucaaa

SEQ ID NO: 2247942 - RNA, 57 nt, Homo sapiens
acugccaaugguaguuugaugggaguaguauugaaucuuucaaauacuuugggcagu

SEQ ID NO: 2247943 - RNA, 55 nt, Homo sapiens
augaaggcugggacaagacaaggugaaucuaguuucuuuggucaccaguuuucau

SEQ ID NO: 2247944 - RNA, 129 nt, Homo sapiens
ggaauuuggcaagaauucuaucuaguaauuuauaaagauuugagggaggccucaguuuacauauauuuuuuaagucugaauuugagguuuuccuagaaauaaauagcuacaauaauauuuuaaaauucc

SEQ ID NO: 2247945 - RNA, 79 nt, Homo sapiens
uggccacauuaggacuguguuucaaaagagcacaguggaaaaccacaaagcuucuugagacuuaggcuuuggaugguca

SEQ ID NO: 2247946 - RNA, 59 nt, Homo sapiens
gcccugcagggguugcagugguccaggcaguaaaggguuuucucaaccucaugcagggc

SEQ ID NO: 2247947 - RNA, 67 nt, Homo sapiens
agucaugugucuacugaugauguaguuaaggcugugucuagaucuaucucucagcagggacgugguu

SEQ ID NO: 2247948 - RNA, 56 nt, Homo sapiens
uugagauggaguuucgcucuuuuugcccaggcugaagugcaacgacucaaucucaa

SEQ ID NO: 2247949 - RNA, 72 nt, Homo sapiens
uuuccauggcacaucuuuucugacuaggucauuuauaucugaaaauagcauuucuuaacaugugcuaggaaa

SEQ ID NO: 2247950 - RNA, 57 nt, Homo sapiens
aggugauaccuuccuauagucccagcuaccggggaggcugaggugggagaaucgcuu

SEQ ID NO: 2247951 - RNA, 122 nt, Homo sapiens
uccuggcgcuuccagguugcucaguucaacagccauugucuuaaauuauuuucagaauagccacaaauuugaauggaauguuggaacuauugcgaacuguccuuaagaagauguucccaggg

SEQ ID NO: 2247952 - RNA, 63 nt, Homo sapiens
cagcuggaaagagguuuuuuuggguaaaaucccuagaaacauucucuugccuccuuccagcug

SEQ ID NO: 2247953 - RNA, 56 nt, Homo sapiens
uuucacuuuucucucugcuacacgcuguggagcuaggcaugaauggaaaagugaga

SEQ ID NO: 2247954 - RNA, 72 nt, Homo sapiens
gauucuuguguguguguguaaaugucugggcuacaugagaaaguuuuuacauguauauaaugcauagcgauc

SEQ ID NO: 2247955 - RNA, 70 nt, Homo sapiens
uggcaaaauggaauauguugggguaaaauauuucgauuuucuucuuuaucccucaugugauguuaugcca

SEQ ID NO: 2247956 - RNA, 55 nt, Homo sapiens
uccuuugguuauaggcaccucugcuuguuuaugcagggggcauuggccggaagga

SEQ ID NO: 2247957 - RNA, 66 nt, Homo sapiens
ugucguugguucuguuuaugugaugaauuacguuuauugauuugcauauguugaaccaagcgugca

SEQ ID NO: 2247958 - RNA, 73 nt, Homo sapiens
gagcucagaucuuucaguuuucugccaaaaacguuuauacuuuuuggcagaaaacuaaaagguauaaaaguuu

SEQ ID NO: 2247959 - RNA, 65 nt, Homo sapiens
uuauuuaagaugcagucauacuggaggagggcaggcccuuaauccaaugacugguauccuuauaa

SEQ ID NO: 2247960 - RNA, 76 nt, Homo sapiens
caggucaggauuuguuggcauuagugaugccaucagaagaaagaagguguucaucacuaauaaauagauccacuug

SEQ ID NO: 2247961 - RNA, 57 nt, Homo sapiens
cagaugcaugaccugggcuuggccaaugggguacagccacauaggauuuugcaucug

SEQ ID NO: 2247962 - RNA, 87 nt, Homo sapiens
gcauuacaauggcaaugaaauagugagaguggauaaccucgucuuguuucgauuucaaagcuuucaauauuuuaucauuguguaugu

SEQ ID NO: 2247963 - RNA, 67 nt, Homo sapiens
uggauuuuacccaaagaacuauauuagcgcaggauuuuaaaugugggauaugacauggguaaaacca

SEQ ID NO: 2247964 - RNA, 100 nt, Homo sapiens
cuaucugaugaauaucuauuccuaggcuaaauugacagaauuuuauuuauuuauucuuuuucuuucacaagugagaggaauuagauagacagacagauag

SEQ ID NO: 2247965 - RNA, 73 nt, Homo sapiens
uugucaaaacccauaauuuguauaacacugagaaugaaccuucauguaaacuacagauuuugggugaugauga

SEQ ID NO: 2247966 - RNA, 78 nt, Homo sapiens
cucugcccagugggcacugcucugggcacaucaggcgcuguccucugcacaguccagugcccacugaggaaggcaggg

SEQ ID NO: 2247967 - RNA, 103 nt, Homo sapiens
uuuguucaccagugcauccccagugcuuagaacuugguaaaugcucaauaaguaucuguugagugaaggcuguguucuuggaggggaguauucuuugaauaaa

SEQ ID NO: 2247968 - RNA, 97 nt, Homo sapiens
cuggcuuugguagguguggcaaacagugaugcaguacguagaggagaaaggcugguuucucuuuacucucauccuggagcggcacgggcccugcugg

SEQ ID NO: 2247969 - RNA, 62 nt, Homo sapiens
agugaauugagcucaacacuaaucaauuaaauaguugacugguguuuaaugagucaaaugcu

SEQ ID NO: 2247970 - RNA, 58 nt, Homo sapiens
ugagacggagucucgcucugucacccagacuggagugcaguggcgcgaucuccgcuca

SEQ ID NO: 2247971 - RNA, 70 nt, Homo sapiens
gguauuucuaguucuagauccuugaggaaucaccacacugucuuccacaaugguugaacuaguuuauacu

SEQ ID NO: 2247972 - RNA, 56 nt, Homo sapiens
caguuuuagggcaaugugaagagugcauuucucucucaccuguugcgaugaagcug

SEQ ID NO: 2247973 - RNA, 106 nt, Homo sapiens
uccaucuguaaucuuaagagagaacugauuggaugugggcacguuccucagauucuaugcccaacuccaaucaguucucucucucuucccucggauuauagaugga

SEQ ID NO: 2247974 - RNA, 119 nt, Homo sapiens
uaaauuccuuuaauagauauagggauacucugguuauauauuucuucaugaguaaucuuugguaguugaugucuuucauggaauauugaccauuuuaucuaaguuguugagcuuauuua

SEQ ID NO: 2247975 - RNA, 91 nt, Homo sapiens
cuucuuuccuccauaugacuggauuaguucuccagcaaggguucuuuacugggcugagauggcugaauucagaauauggauaggaaugaag

SEQ ID NO: 2247976 - RNA, 60 nt, Homo sapiens
aauggauauaucauuuaguuaaccauggguauauucuguuaagugaauguguacucuauu

SEQ ID NO: 2247977 - RNA, 66 nt, Homo sapiens
auccauccacucugaaaugggggugcuuacuagcugguacugaccugucauucagaguuggggggu

SEQ ID NO: 2247978 - RNA, 87 nt, Homo sapiens
uauuugaacuuuggguucuuggacuaguucaacagcauuucaccuuaagagcuguuuuucacuagaccaacgcucaacccucgagua

SEQ ID NO: 2247979 - RNA, 59 nt, Homo sapiens
cuuuuagugcaucagacacccucucucacuguucagaaaugagaggaugcaucuaagag

SEQ ID NO: 2247980 - RNA, 90 nt, Homo sapiens
ggcuuagcuagaugcugggucaguagcauguaugucuuuuauuugugagaucacaucagcuuuggcuacuuaaugcaacauagcuaggcu

SEQ ID NO: 2247981 - RNA, 128 nt, Homo sapiens
auauuuauaccugugccucgaggcaguauuuuaaauaauggagguagacauugggaagagccucguggcuucuuuaaaaacgucgccucgguguuugaggucuccggcacgacacuguggguaaaugu

SEQ ID NO: 2247982 - RNA, 79 nt, Homo sapiens
aggcugaaaugcaguggugugaucuuggcccacuccaaccuccaccucccggguucaagugauucuacugccucagccu

SEQ ID NO: 2247983 - RNA, 82 nt, Homo sapiens
aguuuuaggguacaugugcacaaugugcagguuuguuacauauguauacaugugucauguugguguacugcacccauuaacu

SEQ ID NO: 2247984 - RNA, 111 nt, Homo sapiens
agcagccacacaaaaaacagggcucuggccucucugauugcccagagugaugacuguguuuucacauucaagggauuucaggaggcuaaaaggaucuuuguuuuuucugcu

SEQ ID NO: 2247985 - RNA, 64 nt, Homo sapiens
gacauuuucaauacacaugcagcuacuuuucccuaaaauagcacugcuaugguuugaauguguc

SEQ ID NO: 2247986 - RNA, 86 nt, Homo sapiens
gaggugaggucaugaggaaggagccuuugucugauaguccuuacaagaaaagacaccagagagcaugcucuuucucucccucucuc

SEQ ID NO: 2247987 - RNA, 62 nt, Homo sapiens
cucucugagccccagacaccuuaucuguaauaccagggaaaggauguggaugggcuagaagg

SEQ ID NO: 2247988 - RNA, 100 nt, Homo sapiens
gagacaagagaauugcuugaacccuggaggcugagguugcagugagucgagauggcgccauugcacuccagccugagggacaagagcaaaacucuuucuc

SEQ ID NO: 2247989 - RNA, 66 nt, Homo sapiens
uugagacggggucucacugugucaccuaagcuaaaguguaguggcacaauuuugacucccccucaa

SEQ ID NO: 2247990 - RNA, 94 nt, Homo sapiens
gauggaggacugcuugagccuggaaguuuggggcugcagugaaccacgauugugccauugcacuccagcuuaggcgacagagcgagacaccauc

SEQ ID NO: 2247991 - RNA, 59 nt, Homo sapiens
uccuguaaaacgugauguguucguacguucuagauacacuguacuuauguuuugcaggg

SEQ ID NO: 2247992 - RNA, 93 nt, Homo sapiens
cuuuaagaauguugaauauugacccccacucuauucuggcuuguagaguuucugccgagagauuuggaauggggacauaugaaaauucuaaag

SEQ ID NO: 2247993 - RNA, 85 nt, Homo sapiens
ggagaaucgcuugaacccaggaggcagagguugcagugagccaagauugcaccacacuccauccugggcaacagagagagacucc

SEQ ID NO: 2247994 - RNA, 86 nt, Homo sapiens
cagcugcucaguuucgggcggagacugcacgucguacagaaccaucugcaaacugggaugugagucuucgcuuucucugucagcug

SEQ ID NO: 2247995 - RNA, 58 nt, Homo sapiens
uagaaaguagggaagguaggauuuuaaccuaggguggucuuacuuuuuuuccuuuuua

SEQ ID NO: 2247996 - RNA, 83 nt, Homo sapiens
augguuaagaagugguguuugggagcuggacagacauaacuuuggccagaguuugaauccuagcuauaccacuuacuagcuau

SEQ ID NO: 2247997 - RNA, 96 nt, Homo sapiens
gaaucaccuaaaguucuccuuuuaaaaugcugauauugggccccacuggcagagauggggccccauaucagcauuguaaaaggagggaucugauuu

SEQ ID NO: 2247998 - RNA, 78 nt, Homo sapiens
aacuuuuaucucaaugugucuugacugcacauccaguucccuuuaggaguugagauuuucaaggcacgaauaaaaguu

SEQ ID NO: 2247999 - RNA, 91 nt, Homo sapiens
gcugguccccaccccugaggaaguguuuccccagcggaccuauuuucuggcccuugaggaagugguuccccagaggaagugguagcccagu

SEQ ID NO: 2248000 - RNA, 69 nt, Homo sapiens
ugaagccacucaguuugugguacuuuguugcuguggccccaagaaaguaccacaagccugagguuuuca

SEQ ID NO: 2248001 - RNA, 83 nt, Homo sapiens
guagaguucacauaggaaugugaaucgcuuggucccgagaugcucaaagaauagguaggugucauaauccaugccaucucuac

SEQ ID NO: 2248002 - RNA, 65 nt, Homo sapiens
cugucagacacugagcaaacgacuagcucgagcgaguucagucucaaccuuaguuucugccacag

SEQ ID NO: 2248003 - RNA, 78 nt, Homo sapiens
uuguaaguauagcuaugauaaacauucucauuguugccucucucuacauguaagaguuuuucuuggcuauauaugcaa

SEQ ID NO: 2248004 - RNA, 71 nt, Homo sapiens
cuucuggcuggggcacagucugaauguuucugaauccagcaaagaaugcagauuugccucagggcuugaag

SEQ ID NO: 2248005 - RNA, 58 nt, Homo sapiens
caaagcaaugcacuccugaccaaguagauucuuuuaaaaauuagagugcauuacuuug

SEQ ID NO: 2248006 - RNA, 58 nt, Homo sapiens
uguggcagaguggacauuuaaauguaggaaaaccacauuuuuaaacuacccugucaua

SEQ ID NO: 2248007 - RNA, 76 nt, Homo sapiens
ggugccaaaguaauugugguuuugccaugacuuuuaaugguaaaaauugcaauuauuuuuaucaucauuuugcacc

SEQ ID NO: 2248008 - RNA, 63 nt, Homo sapiens
guaguuuauaguacuauugcaguguuauaauuaguguuaccacuguuacugguauuauacuau

SEQ ID NO: 2248009 - RNA, 63 nt, Homo sapiens
cccaacacuuuccagaugagggagaaguagaacugcuugccucucacacugaauguguguggg

SEQ ID NO: 2248010 - RNA, 87 nt, Homo sapiens
ggagucuugcucuguugccuaggcuggagugcaguggcaugaucucggcucacugcaaccuccgccucccgggucaagcaauucucc

SEQ ID NO: 2248011 - RNA, 84 nt, Homo sapiens
gugaauauuggagaagugcuuuuggacuaacaguaguaccauaaauaacuguuacugaguuaaagacaucucuaugugauuuac

SEQ ID NO: 2248012 - RNA, 95 nt, Homo sapiens
agaagccucuuuuucauguccagggacagcgggacucugacagcugagagcuggugggcggcugucucaguucccuucucuggacaagagcuucu

SEQ ID NO: 2248013 - RNA, 102 nt, Homo sapiens
ugaggcaggagaaucacuugaaccugugaggcagagguuguagugagccaagauugugccauugcacuccagccuaggcaacaagagugaaauucugucuca

SEQ ID NO: 2248014 - RNA, 62 nt, Homo sapiens
gccuguaauuccagugaugggaggcugagacuggaagauccuugagccugggaguuauaggc

SEQ ID NO: 2248015 - RNA, 83 nt, Homo sapiens
gcuggaggaaugcagaggcgggcgggggcgcgacaggcugcuaggcaccgugcccacugucuguccuguagcuuccuaccagc

SEQ ID NO: 2248016 - RNA, 130 nt, Homo sapiens
ucuuuuguaaauugcccagucucugguaugucuguauuagcagugugaaaacagacuaauauaugugguguauuaguccguucucacacugccaugaagacauacccaagacuggguaauuuauaaagga

SEQ ID NO: 2248017 - RNA, 58 nt, Homo sapiens
ugaguuaggaucucacugugucacccaggcugcaguacagugacaggauccuagcuca

SEQ ID NO: 2248018 - RNA, 89 nt, Homo sapiens
cacggcuccguuauugcuaacaucccuuauguacugauuaugugcacagcacauugcuaaguggguggguaauagaaggguaggcugug

SEQ ID NO: 2248019 - RNA, 59 nt, Homo sapiens
gauuccacuuucugucucuaugaaauaaaauacucuagggaccucagauaaguggaauc

SEQ ID NO: 2248020 - RNA, 59 nt, Homo sapiens
uucagaguggacagaaauuaagcuuaauucucuuugauaaauuuucucuccagucugag

SEQ ID NO: 2248021 - RNA, 58 nt, Homo sapiens
cugugagaugguaaauuuuuguuguguaagccacacagcguguguuacuuucuuacag

SEQ ID NO: 2248022 - RNA, 62 nt, Homo sapiens
gaugguuuuacauuuuaauguuugaaaacauaauuuugguucaauugcaguguaaaacuauu

SEQ ID NO: 2248023 - RNA, 116 nt, Homo sapiens
auggagguguaaagauauccagcuuuauuaucuuugcauaacaauguauguguguauaucuguaaguauaugcauacauguaugcaggaauguuaauuguuguauuacacuucuau

SEQ ID NO: 2248024 - RNA, 83 nt, Homo sapiens
gccaggcaaauaggaccaugguauugcuuugggcuggcauagaugcaauuccauguaauuccauuucuuguuauaaacuuggc

SEQ ID NO: 2248025 - RNA, 55 nt, Homo sapiens
caguuggguacaauguacacuauuuaggugaugaguacauuaaaagcccagacug

SEQ ID NO: 2248026 - RNA, 73 nt, Homo sapiens
ggacgugguguuugguugauagagccacugaggcuggagcacaguggcuguaucucggcucacugcaacuucc

SEQ ID NO: 2248027 - RNA, 58 nt, Homo sapiens
ccucagcuccuaucucuguauggccugguuuuuccuagguuaugauuauagagcgagg

SEQ ID NO: 2248028 - RNA, 66 nt, Homo sapiens
gcauccguugcaagggaagaaugaagacaaaaaucaucuacuguuuucaaccaugcacaugggugu

SEQ ID NO: 2248029 - RNA, 73 nt, Homo sapiens
cccuguugauggcugucacagcaauuuaugguuuuaaauuauaaaugcuuccagucauuaaaaagugacaggg

SEQ ID NO: 2248030 - RNA, 64 nt, Homo sapiens
auugugaauggugccacaauaaacauacauguccaugugucuuuauagcagcaugauuuauaau

SEQ ID NO: 2248031 - RNA, 57 nt, Homo sapiens
uuaccucagaccugcucugugugcauagaggacagaggguaguuugugugcaggugg

SEQ ID NO: 2248032 - RNA, 64 nt, Homo sapiens
auugugaauagugcugcaaaaaacauacgugugcaugugucuuuauagcagcaugauuuauagu

SEQ ID NO: 2248033 - RNA, 87 nt, Homo sapiens
aucgugcuagcaaauacuaggucuuauucuuuuuguuuggagauagagucuugcucugucauccaggcuggagugaagcggcacgau

SEQ ID NO: 2248034 - RNA, 72 nt, Homo sapiens
uaaagcuguuguacacuuuaccuuuaaagacuacuuguguguguuaagggggcugagguguacacaucuuug

SEQ ID NO: 2248035 - RNA, 101 nt, Homo sapiens
guagggcuuuaggaaugggguugugucacugugggaauagcagucaccaccacaauaugcucacagugacacgaacccccacaaaauccuccugucccuac

SEQ ID NO: 2248036 - RNA, 87 nt, Homo sapiens
uuguuuuauuaguuuggaauguauaucguuuuuugucaaacugaaagguuuacaaucccacaugcuuccaauaauuugaugagauga

SEQ ID NO: 2248037 - RNA, 70 nt, Homo sapiens
gauauuccuauccuuaagucuucucaacuugaauucacguguuacugaaagacugaagaauaggcauguc

SEQ ID NO: 2248038 - RNA, 85 nt, Homo sapiens
uuuccuguguguuuucaucugauucuuucagaaacccucucuguuaggaauggcagaugaaauugucauuuuacauaugaggaaa

SEQ ID NO: 2248039 - RNA, 116 nt, Homo sapiens
ucauuuuguugcuuuccacugugcuucccugaguaucuuaccaugggggaauuuauuucaaauugcaucacucacggaagacaauucuagggaaaaaaaugucaggucaacacuga

SEQ ID NO: 2248040 - RNA, 68 nt, Homo sapiens
ggcaauuccaaggcgugagguugcacuucuaguugucuugagaugcaccuugucacguuucuccugcc

SEQ ID NO: 2248041 - RNA, 76 nt, Homo sapiens
aaucagaggaggauugacauguaggcagggaauggguaauauccggccuugagugcuauguuaagggcuuuggauu

SEQ ID NO: 2248042 - RNA, 64 nt, Homo sapiens
uucuuuaugucaagaacuuuacauagaguaguuuuacuuuauguggagcacuugacacacagaa

SEQ ID NO: 2248043 - RNA, 107 nt, Homo sapiens
cacccgaugcccccuuagacuguuguaaugcacagcuggucauuuaagagcccugagaaguccuuggaucauggaguauuugcaagucuaacgggaggcacuuggug

SEQ ID NO: 2248044 - RNA, 63 nt, Homo sapiens
uagacugguuuagcacugaauagaauuaaucuugacccagagagugcuaaauauaacagucua

SEQ ID NO: 2248045 - RNA, 77 nt, Homo sapiens
gcccccauguagcaaaacugucccagguccauauuauacaaacugugcugggcagugggacagcuuugugugguggu

SEQ ID NO: 2248046 - RNA, 65 nt, Homo sapiens
agggagucaggaggugaaggagaaccagugcuaccaucuggcguuuacuuccuuccugucuuuuu

SEQ ID NO: 2248047 - RNA, 86 nt, Homo sapiens
cccuaagaucuuugucucuguuuagagccagcaauuuugaaaucaccucacaguagccugucuuggaauagaugccuagauaaggg

SEQ ID NO: 2248048 - RNA, 107 nt, Homo sapiens
gcugugugugcauaugugaacacauacaugcaugggcaugugugcaugugaaugcaugucaugugcaugcaugagccauguguggugugugcaugugugugugcagc

SEQ ID NO: 2248049 - RNA, 67 nt, Homo sapiens
gaugcccaaacaaaagcauaucaauugaguacugccagcaguugauaugaauggcuguuuguguauu

SEQ ID NO: 2248050 - RNA, 81 nt, Homo sapiens
gccuguuguuugaugacucuguggccccaggcccagcccuguggaagccuggaguauacggccgggguuuguggcacaggc

SEQ ID NO: 2248051 - RNA, 78 nt, Homo sapiens
ugcccauuauaguaauaucuucuuugaggaguccacauccuuugcuuuuauuucuucauguauucccuguaaugggua

SEQ ID NO: 2248052 - RNA, 59 nt, Homo sapiens
caugaaugauuuuaaaagccucucuggggucaguggagaaguuaggaaaaucauucgug

SEQ ID NO: 2248053 - RNA, 112 nt, Homo sapiens
uauaggaauauauagaugagaaauuauugacuugauauauagcugauuaaaauaauucuaaucuggcauauguacaaguuacuuauguuucauauuaccuauaauucuuaua

SEQ ID NO: 2248054 - RNA, 80 nt, Homo sapiens
ugaggcaauucugauggaguaguccacagauccacuuugaagacacuaucugccuauuaccauaagaggaaccagccuua

SEQ ID NO: 2248055 - RNA, 109 nt, Homo sapiens
uguuauagaagucucucaauagugcuuuuuagaaccuggauguuaagugagaucuuuggucaacuuucagguuuuaugaaguucauggaaaugagacacuucuuugaua

SEQ ID NO: 2248056 - RNA, 78 nt, Homo sapiens
cucuuugaucaucagcuuugucaucuguaaaaugggcauucugccuacuucaaagagaaguugaagggauuaaacgag

SEQ ID NO: 2248057 - RNA, 73 nt, Homo sapiens
uucuaaaugcuaucuggaacauuguugcaacaagggaggaugucgcacagcaaugcaccaauggcauuuggaa

SEQ ID NO: 2248058 - RNA, 83 nt, Homo sapiens
acuacauuuaucagacugaugcagcuaggauuugugacaugauuuagauuucaucgaugagcugcauuuucaugaaauguagu

SEQ ID NO: 2248059 - RNA, 92 nt, Homo sapiens
ugugugcacaaauauguugacauauguguguccacauacauguaaacauauguauguguacguguacacauguuaacauaugaaugcacaua

SEQ ID NO: 2248060 - RNA, 55 nt, Homo sapiens
gugggaagcuggaacucccuccaucucucugugguaaggagguuccccuacccau

SEQ ID NO: 2248061 - RNA, 55 nt, Homo sapiens
guuaaggaucuugagaugaggagaaccucuugacuuaucucaguuuguccuaaac

SEQ ID NO: 2248062 - RNA, 73 nt, Homo sapiens
cuccuauuuccgugacaaucagauagcuacaacuuggagccaggccccuaagugaacugucacugagaaggag

SEQ ID NO: 2248063 - RNA, 86 nt, Homo sapiens
acucagcagucaggggagauggcaaugcgaugaugacugagugucuuagucuuuuuuguauugcuaugcaauaucugaggcugggu

SEQ ID NO: 2248064 - RNA, 70 nt, Homo sapiens
ugagauaggaucauuuuauguugcccaggcuggucuugaacuccuggguucaaaugauccuacugccuca

SEQ ID NO: 2248065 - RNA, 120 nt, Homo sapiens
ccauuccugugcacuuaaccucaggaaauaauuugauagaagaaaaacauccuguaugcccagagauguuuguuucacugucacccaugagauuggcaugcuuuucaacagcaggggugg

SEQ ID NO: 2248066 - RNA, 67 nt, Homo sapiens
gcuauaacaggaaauacagggcuuugggucuuuucuauuccagauucuguuccuguccucuuuuagc

SEQ ID NO: 2248067 - RNA, 98 nt, Homo sapiens
ccccauaucagaggugguuuggcagagggguuaggagacuagacuccaccuaacucucuaaauccuggcuccacuguuuauucccucuggguuugggg

SEQ ID NO: 2248068 - RNA, 67 nt, Homo sapiens
uagcaaagggaaagaagggccuggagggcauugugugccgaaggaggccaguuuuuccugcuugcug

SEQ ID NO: 2248069 - RNA, 62 nt, Homo sapiens
ucaguuugccaguauuuuauugaggauuuuuccaugaauguucaucagggauauuggccuga

SEQ ID NO: 2248070 - RNA, 90 nt, Homo sapiens
gcuugcaaaggguagaggaaggauuggaaacgcagagccauuggacuggaacgccauuguguauuccucccauccuuuccugcuccaggc

SEQ ID NO: 2248071 - RNA, 80 nt, Homo sapiens
auuuauuugcauguaagucgcuuaguauaucugcaucuguauuucuauuugugggguaggugacuugaugagggaugagu

SEQ ID NO: 2248072 - RNA, 86 nt, Homo sapiens
ugugcuguauucauaaauuugcuuagagccaaucuugauuguuucuucauuucaauuaagagagaguugaagcaagaaauagcaga

SEQ ID NO: 2248073 - RNA, 99 nt, Homo sapiens
uuuucagugauauauuuuacuggcuuucacugguguuagaguauaacuggcuuucugaaaugacuuagugaaggucuguccugcuguauauccugaaaa

SEQ ID NO: 2248074 - RNA, 66 nt, Homo sapiens
gggacugagauggagacuuggccuuaaaucagacccuugauuucucccccuucuccagucuuuccu

SEQ ID NO: 2248075 - RNA, 88 nt, Homo sapiens
ggagaaucgcuugaaccugggaggcugaguuugcagugagcggagaucgugccguugcacuccagccugggcaacagagugagacuuc

SEQ ID NO: 2248076 - RNA, 55 nt, Homo sapiens
uucuucuuaggugaugaagaggucauuuuaacuucuacagccaguucaggaagaa

SEQ ID NO: 2248077 - RNA, 56 nt, Homo sapiens
agcauuaguugugaagccuuuauuacauguauugaaguuuucauacagacuaugcu

SEQ ID NO: 2248078 - RNA, 79 nt, Homo sapiens
cuacacucuuggcaagaauguaugccgaucccaucauucuggagggggaauuggcacaauucuaugucuagaaacguag

SEQ ID NO: 2248079 - RNA, 64 nt, Homo sapiens
uuugguauguaauuuauauuguagguuguuagcgcauuaaaccuaugugaauuauuugcucaga

SEQ ID NO: 2248080 - RNA, 69 nt, Homo sapiens
uaacaaggaaacaacuauaauucauuuuaauaaggugcuuguuaaauacagcaugguguuucuguguug

SEQ ID NO: 2248081 - RNA, 64 nt, Homo sapiens
uucgguuugccaauauuuuacugagaaguuuugcaucaacauucaucagggauauuggccugaa

SEQ ID NO: 2248082 - RNA, 72 nt, Homo sapiens
cuguagccuccaacuauuagacucaggugauccuccaaccuuagccuccugggucuguaguuagggcuacag

SEQ ID NO: 2248083 - RNA, 64 nt, Homo sapiens
aguaucucaguucucgugauuagucagguacacuucuuacauugguuuuucggauugagauauu

SEQ ID NO: 2248084 - RNA, 72 nt, Homo sapiens
uacuuccaagacauacaacauucuacuacguggacgcuuuccacugaguggcaaugugauguccugaaagua

SEQ ID NO: 2248085 - RNA, 60 nt, Homo sapiens
auuugucaauacacuucuuccaaguuuaaaagccagucauuggagggauuguuggcaaau

SEQ ID NO: 2248086 - RNA, 80 nt, Homo sapiens
uagcuaggcuaucauauccuagauauaacuucuauuacuauguaagaaguaaagaacggauauuggaaggcaucuagcua

SEQ ID NO: 2248087 - RNA, 62 nt, Homo sapiens
gugggauguacuauucuagguugaaagauuuuucauucagcacugaaaauaugucaugccac

SEQ ID NO: 2248088 - RNA, 121 nt, Homo sapiens
auguucaccucgcagaguagauuaagcagcuggcaugugugaagugcccagcacugugucuagcauaugcuagguacuuggcauguguuucuuucuuucccucccuuguucaaggccacau

SEQ ID NO: 2248089 - RNA, 80 nt, Homo sapiens
guucagcugaugaagaacgggaaacaaauugcuuaauuuuaagaaauggcaaauguuuucuguugaaauguuuacugaac

SEQ ID NO: 2248090 - RNA, 78 nt, Homo sapiens
gcagucacugagauugguauuaaugacaucacuauuaugaaugcugcgauuucaucuaguaucuauucaguuaacugc

SEQ ID NO: 2248091 - RNA, 78 nt, Homo sapiens
uuagauaaaugaggauaguguugaaggcaggaggggauucuccuguucugccccagccuugucgugcuucccaucuga

SEQ ID NO: 2248092 - RNA, 95 nt, Homo sapiens
ggcaaggggugacuccagucaagugcuuucuuggggauuuagugagguuagugacacuagccaagaauaauguacuugcuggagggaucagugcu

SEQ ID NO: 2248093 - RNA, 95 nt, Homo sapiens
ggcauccuaggccacuuugcuuagagggcauuaaaggugccaugaaagguagacucugaaccacuuugaucccucugaaguaggugacugaugcc

SEQ ID NO: 2248094 - RNA, 59 nt, Homo sapiens
ugagacugaguuucacuuuugucgcccaggcuggagugcaacggagugaucucagcuca

SEQ ID NO: 2248095 - RNA, 129 nt, Homo sapiens
ugaugugacugcuuucuacugccuuggcccugcacuuauagugcauugugacacauaacuggauacugcacccaggugaugugacucugcauuuuggguucugccaacagaaagcuuuguaacauauca

SEQ ID NO: 2248096 - RNA, 100 nt, Homo sapiens
uugcaaaggaauugucagacuggaauuuagguugauaguauaauaugacuuacgaucucuuguuccuauagcuugauuuccagaacaaauucuaaugugg

SEQ ID NO: 2248097 - RNA, 57 nt, Homo sapiens
uggacuguaauagagaacagaaagaugagucagaucagucuguggcuacugcagcca

SEQ ID NO: 2248098 - RNA, 86 nt, Homo sapiens
uaaguuuuaggguacaugugcacaacgugcagguuaguuacauauguauacaugcgccauguuggugcgcugcacccauuaacuug

SEQ ID NO: 2248099 - RNA, 86 nt, Homo sapiens
uguccucuggaguaaugguuggcuauucuacuugauagugguugaacaucaucauuaaucaggcaaugcuugcuacccacagggca

SEQ ID NO: 2248100 - RNA, 91 nt, Homo sapiens
uuuuacuauguaacaauuucuuuauauauccaugacagcuaaaacaagcuauuugguuagucuguguguauauauguuuuugcaugugaaa

SEQ ID NO: 2248101 - RNA, 63 nt, Homo sapiens
gcagggcgcugaaauacuaacauggacagauguguuguacauggcuuuauuuucagcuucugu

SEQ ID NO: 2248102 - RNA, 85 nt, Homo sapiens
gaaacagagggaugcucuaugucaaaggauacaguagagcugcucuuuuuuguaccacagggcaugaagugcucuccuuuguuuc

SEQ ID NO: 2248103 - RNA, 64 nt, Homo sapiens
uaagcaaacacuagcuucccucagucauucagaucauggaugaaugccauucuguguuagcuua

SEQ ID NO: 2248104 - RNA, 64 nt, Homo sapiens
guugugaauagugcugcaauaaacauaugugugcaugugucuuuauagcagcaugauuuguaau

SEQ ID NO: 2248105 - RNA, 84 nt, Homo sapiens
ggguccagaauuguuuucaggcagggagcuucaguggucuguggguccacugaucuugagcugaccugauugcacuacugaccu

SEQ ID NO: 2248106 - RNA, 77 nt, Homo sapiens
ugacaauaguauagcaacuaauugacuucaucaaguggcuaccucugccaaauugauaguuuaauuaaugcuaguca

SEQ ID NO: 2248107 - RNA, 58 nt, Homo sapiens
ggcuggagcuggggccugugcagggcuucccaugcugugccacaguuaagcuucugcc

SEQ ID NO: 2248108 - RNA, 59 nt, Homo sapiens
guagcagucacauagcagauugaauuaagguuuguauuagucuguucuuacacuguuau

SEQ ID NO: 2248109 - RNA, 76 nt, Homo sapiens
acuacaaaaggcugaguaaaacagagaacccugaaaaaagaguuauuguccauuuauuuagcacaguuucuguggu

SEQ ID NO: 2248110 - RNA, 81 nt, Homo sapiens
gaauagggaccuuagaauuguauguauguuucuaggcuaauauuugcaagacaugucuaagguuuaaaguuuuuccuauuc

SEQ ID NO: 2248111 - RNA, 61 nt, Homo sapiens
uuaugcauagcaucugcaaauguuaggauagcuguaugcccaagaugcuaugguagcauga

SEQ ID NO: 2248112 - RNA, 76 nt, Homo sapiens
ucacuugaacccaggagguggagguugcagugagcugagaucaccgcguugcacuccagccuggguaacaaaguga

SEQ ID NO: 2248113 - RNA, 88 nt, Homo sapiens
aauaucaagagguggcacucacuggugccaucuugaaagcuggcuacuaccuucaagauggccccagugagccccaccuccugauauu

SEQ ID NO: 2248114 - RNA, 67 nt, Homo sapiens
aggaaucucaggugaggagccccggggaaacaagacuuuucaccuugggucccacuugcuuuuuccu

SEQ ID NO: 2248115 - RNA, 103 nt, Homo sapiens
ucuugccuucagcaaucaccucagcugguucuuugccuuguagagugacucaaaacuucauuccuaaagggacuaggccaguaguuguccugcacggguugga

SEQ ID NO: 2248116 - RNA, 74 nt, Homo sapiens
cucuccugugucaggcacuaguaagaaaaaggcacaacgcuuuuuccucguagagccuaaugucuagaggggag

SEQ ID NO: 2248117 - RNA, 84 nt, Homo sapiens
aucauuauccccugagaacuugcuagaaaugcaaauuuuaugucucaccccagguuuuuaacaaguccuuuaggugauucugau

SEQ ID NO: 2248118 - RNA, 72 nt, Homo sapiens
ccaggcagguggguuccucucugggcauaccacguggagacguguaugguuguaugaggacccaugugcugg

SEQ ID NO: 2248119 - RNA, 62 nt, Homo sapiens
uugugaauggugccgcgauaaacauacgugugcauauguguuuauagcagcaugauuuauaa

SEQ ID NO: 2248120 - RNA, 85 nt, Homo sapiens
ggagggcaccauggcacuguaugaaaugugcugggcucaucuagcauauuaaggauucaguguugaauagacgugagugcccugc

SEQ ID NO: 2248121 - RNA, 91 nt, Homo sapiens
ucuaccuauugugguuuuuaaaguaccugugguccaggggcaguggcucacaccuguaaucccaggacuuugggaggccaaggugggcgga

SEQ ID NO: 2248122 - RNA, 83 nt, Homo sapiens
uugucaucagcuuaagagcuuaaucugauguuaucagcuuaagagcuuaaucugauguuaucagcuuaagagcugucagacgg

SEQ ID NO: 2248123 - RNA, 89 nt, Homo sapiens
ggggaaggggugaugagauggaucuuggauuugaacccaucaguuuguguuagaaccuaaguucucuuucuauguuauaacccugcccc

SEQ ID NO: 2248124 - RNA, 69 nt, Homo sapiens
agacacauuccaagcauuacaaugugaugcuacuccaucacauuguuauguaaauguuuugaaguguuu

SEQ ID NO: 2248125 - RNA, 116 nt, Homo sapiens
uuugcuuaaucacuuccagugauggcgagcucacuaccucuacaggcagcugguccaaggugaugagcuugcaccagugccagagcuggugagacacccaggggaaguuaagcaaa

SEQ ID NO: 2248126 - RNA, 76 nt, Homo sapiens
ucacuugaacccaggagcuggaaguugcagugagcugagaucacaccacugcacuccaguuuggaugauagaguga

SEQ ID NO: 2248127 - RNA, 68 nt, Homo sapiens
gaaccucuauacuguuuucuauaguggcuguaccaagcuacauugccacuaacaguauacaagaguuc

SEQ ID NO: 2248128 - RNA, 65 nt, Homo sapiens
gacucaaaagacaggaccagucauugcugcagaaacaagcagggugacuacuggucucuuggguc

SEQ ID NO: 2248129 - RNA, 62 nt, Homo sapiens
auaagaugauguuuauaaaaggcauugcauaaugauuuguuaugucaagaaacauuacuuau

SEQ ID NO: 2248130 - RNA, 72 nt, Homo sapiens
aaucuaccaagcuauacgcaaaagguuauauuuaaauaaguuuaauguuacaguauugguauuugguagguu

SEQ ID NO: 2248131 - RNA, 89 nt, Homo sapiens
gggggcgcucggcucagaucacuggcgcuggcggagacaccaagucuguagacuggcuccgagguggccgguggucuaggggacccccc

SEQ ID NO: 2248132 - RNA, 83 nt, Homo sapiens
caugcuugcuugcauccguguaugugcuuauaugauuuuuauauguaaagugguguuuguauuuaugcaaaugugcaggcgug

SEQ ID NO: 2248133 - RNA, 129 nt, Homo sapiens
uuguauuuuauucacuuauuguagacccucaugagguagcccauuuguuuagggaaaguaggcauaauguauauuuuccuuaaaaguuggcaaacuucaugugaacccgccaagagaaauagaguauag

SEQ ID NO: 2248134 - RNA, 58 nt, Homo sapiens
auccugccaaaacugaguccuucccuucaaggcaguagguucccuuuuggccugggau

SEQ ID NO: 2248135 - RNA, 61 nt, Homo sapiens
uagguaggacguaguccuuuugacugugaauuccuuuagcuuaaggaccgugucuuauuua

SEQ ID NO: 2248136 - RNA, 75 nt, Homo sapiens
guguuagugcucucguuagauguuucuguugauguuagaugucagaugauuccguugacgagaagggcugaccac

SEQ ID NO: 2248137 - RNA, 71 nt, Homo sapiens
ucuuauauggcuuuguucaacagccucaccuaauuucaggaaaguagagguguaaauagagcuaaauaggg

SEQ ID NO: 2248138 - RNA, 66 nt, Homo sapiens
cucgacauuaaggcuugaucuuggugagaugauggaccauuuuaucucuagggccuuaucuuugag

SEQ ID NO: 2248139 - RNA, 129 nt, Homo sapiens
agcuaaaaaaaaaucccagaaacugacuagauauuguucuaugucaaaagaagugaggacuccuucuugucucuauuaugacauggaauugugucucaguuuauuucaggggagaaauaauuuaaaaau

SEQ ID NO: 2248140 - RNA, 55 nt, Homo sapiens
aacucacuuuguggcuucugaagaagggaccuuuguggacugucauggaguaguu

SEQ ID NO: 2248141 - RNA, 129 nt, Homo sapiens
ccaccccucccucuuuugaguucagugccuugcucagccccuccccuguaucucagcgucuucagaccucugacagagcgacgauguagggucucccggggcccaagguggucucagggucaggggugg

SEQ ID NO: 2248142 - RNA, 81 nt, Homo sapiens
accccgcccaacuagucacaggaguugaaggaugacacaguagagaacugggauucuggaguccuguggcuggucuggggu

SEQ ID NO: 2248143 - RNA, 73 nt, Homo sapiens
uagaugcauacaauaaaacauuggcuggacauuuacuuuguuccaacuagcuuccaguguuauuuauguucua

SEQ ID NO: 2248144 - RNA, 63 nt, Homo sapiens
uuuuuauauuugauuaacaagagccuaaaugcuaacugauuuaggcgaggucagauaaagaaa

SEQ ID NO: 2248145 - RNA, 56 nt, Homo sapiens
cagacuggauguagggaaaagggagcuuucccuucuugguugcucacacccaucug

SEQ ID NO: 2248146 - RNA, 91 nt, Homo sapiens
gauugacucuuucaugaaagauuucucuguagcauaugaugcuguuugacagcauauuacaguagaaugucuuucaaaauugggguuaauc

SEQ ID NO: 2248147 - RNA, 65 nt, Homo sapiens
gguaaugguaagauaguauguuuaacccaggccugccuggcacauagaacuauuuuccuuuuauu

SEQ ID NO: 2248148 - RNA, 77 nt, Homo sapiens
aauaccaugaauaagaauugccagauuugaaaugcuuuguuaagcuuuuuuuaggcaugcaguucuauuuaaguauu

SEQ ID NO: 2248149 - RNA, 115 nt, Homo sapiens
gggagagcuacuguuuuauuugguuacauagagaagguagcaguaaaggaacugaaugauacuggaaaccuguuugcccuuuagguaacuauauagaacugaaaagaccuuuccc

SEQ ID NO: 2248150 - RNA, 90 nt, Homo sapiens
aguagcuauauauaaacacauacacacauguguauaugugugugcacgcauguaugcacauauguguauguauuuguguguauaucuauu

SEQ ID NO: 2248151 - RNA, 84 nt, Homo sapiens
agagcacuccuucaacaggucaauugcauagaaucccugucuugggcucugcuucuagggcaguugaucugaaacaguagcuuu

SEQ ID NO: 2248152 - RNA, 88 nt, Homo sapiens
augguuucccuugagcauauucuauauuaaaacuuuuacauucuggcuguauuugguagagaauaugaucaaaagucagggauauuau

SEQ ID NO: 2248153 - RNA, 66 nt, Homo sapiens
uuuuguguaaaaugagcuacugaauuaauaaaaaugaaguuaaaauuagugcucaguuugacaaaa

SEQ ID NO: 2248154 - RNA, 81 nt, Homo sapiens
guuacaggugcugacaugcagccacugcaccugcccugacauugggcagauggagcccugaugcucagauccaccagugac

SEQ ID NO: 2248155 - RNA, 92 nt, Homo sapiens
gauaauacauguaacauguuuagcagauaccugucugacauuuacugugugcucaauagguguuaguuaauguuauuauuaauguuauuauu

SEQ ID NO: 2248156 - RNA, 59 nt, Homo sapiens
gcuuagcaagcugagagccacugucucuuuuacagagcauggcucuuugcugcuaaagu

SEQ ID NO: 2248157 - RNA, 67 nt, Homo sapiens
gauuagagucagaggcagcccuggaaucuagcccuccuggucuuaggucacugcucugugucuaauc

SEQ ID NO: 2248158 - RNA, 93 nt, Homo sapiens
ggaauccccuuuguagguuucauaguuuauacugauauuucugaugucgucucagagaauuagucacaauuauaggaacucagaaggcauucc

SEQ ID NO: 2248159 - RNA, 72 nt, Homo sapiens
uggagugcagugugauguuuuaaucuauguauacaucauagaaugauucagucaugcuaauuaacacaucca

SEQ ID NO: 2248160 - RNA, 75 nt, Homo sapiens
uuguuuuucuuugagaugaagucuugcucuguugcccagguuguagugcaguggcuccaucucagcucgcugcaa

SEQ ID NO: 2248161 - RNA, 83 nt, Homo sapiens
ggcagauugggucaguugauuuguuuuuccuucaugcauuuauuauauauaugacuuuggaaaaauuacuugaucuuucuguc

SEQ ID NO: 2248162 - RNA, 62 nt, Homo sapiens
gguggaggcuuugacuggguaccaaggagguucucucauuugguggcuacagaguaaccacc

SEQ ID NO: 2248163 - RNA, 60 nt, Homo sapiens
gguaugcucauuuucaagguugauaggcauugccaguuggugaccugaagagaguaaacc

SEQ ID NO: 2248164 - RNA, 59 nt, Homo sapiens
aguugauuuguagaaugccccaacagaugauuuuguuugguguuacuucaugaucaauu

SEQ ID NO: 2248165 - RNA, 61 nt, Homo sapiens
gaagaaaaauacagaggaaaauuaggcuauagugcuggcuuucuuacucugguuuuucuuc

SEQ ID NO: 2248166 - RNA, 65 nt, Homo sapiens
aaaaggcaagaaaauggauucucccugugaaaacagccgaagggagaugccaacaucuugauuuu

SEQ ID NO: 2248167 - RNA, 85 nt, Homo sapiens
gggcugaucacauuaagcuguuauuucuuaucuucaucucauuuccccuuagauaagaaaaacauuuuguaugcuuggucaaccu

SEQ ID NO: 2248168 - RNA, 56 nt, Homo sapiens
auaguaaacauaguucuuuugcucuaaaucuagagcaauuguggguauguuucugu

SEQ ID NO: 2248169 - RNA, 68 nt, Homo sapiens
gccacuuccaggaguuuuuauuucauccuaggaagcccuugaugcaaauuaagcuugggacagguggc

SEQ ID NO: 2248170 - RNA, 56 nt, Homo sapiens
caccuguacauggcaguguccucugggcacagagaccuacugcagcuguggcagug

SEQ ID NO: 2248171 - RNA, 78 nt, Homo sapiens
gcugaaaguacauaaguuugaguagucuagaguggaaugugguuaaauaucccugcagauuacuuuauguguuucagu

SEQ ID NO: 2248172 - RNA, 67 nt, Homo sapiens
cucccuaugucauagauaaggaaguggaggcccagcucacuugccaagcucccauggcuugagggag

SEQ ID NO: 2248173 - RNA, 96 nt, Homo sapiens
augaagagguaggagguaagguaguuguccuaauaacagcccauaguucaaguguauugcagugugacgacuauauuuauuauugcugaacuucgu

SEQ ID NO: 2248174 - RNA, 71 nt, Homo sapiens
guuuugauagauuuuuauucaugacaaaauaagaaaaauccuaauuugucacucuuggagguuguuaaaac

SEQ ID NO: 2248175 - RNA, 59 nt, Homo sapiens
guuguaacgcuaguaucaccaggcuaaguuccuagccaggucacacuguguguuaaagc

SEQ ID NO: 2248176 - RNA, 101 nt, Homo sapiens
aagcaacaugaagcccaaggagcuuaagugacuuguacaaagaaccccgcuaauuagcaguacaguucgugcuagagccuuuggugcugucagcauugcuu

SEQ ID NO: 2248177 - RNA, 73 nt, Homo sapiens
uugguauaaaaagacugaaguauaccaucaaaauagugguauaaggcuaaggacuugaguuauuuuguauugg

SEQ ID NO: 2248178 - RNA, 65 nt, Homo sapiens
uuaggucuuaagucuuuaaugcauuucgagugauuuauuguguauguuguaagacuuagaccuag

SEQ ID NO: 2248179 - RNA, 105 nt, Homo sapiens
gcagagguuaaguaacacgcugaggacacaggcuucagagaggggugaagcuggccuuugaagcuagguuguccaucucuagaagccacacccuuaagccucugc

SEQ ID NO: 2248180 - RNA, 93 nt, Homo sapiens
aauuugaaauauuaacugggcauggugguacacaucuguagucucagcuacucaggaggcugagaugugaagaucacaugaacccagcagauu

SEQ ID NO: 2248181 - RNA, 73 nt, Homo sapiens
uggccggccuguguggagcagguggcaugugugaccuugugcgucucugugcaccucuucacacagggagcua

SEQ ID NO: 2248182 - RNA, 59 nt, Homo sapiens
ucaugaagaucucugccuuguguccaagauucuuggacaaagcagcaguaucuuuauga

SEQ ID NO: 2248183 - RNA, 82 nt, Homo sapiens
gguaacagugggcaugcauuuuccuaacuagaauugaauaguggcuucccuuuuaggugggaaaugugcuuuccauuuugcu

SEQ ID NO: 2248184 - RNA, 60 nt, Homo sapiens
ugcucacugagaaacaauuacaauuauucauaguaagacagguaaugugcuucaguagca

SEQ ID NO: 2248185 - RNA, 99 nt, Homo sapiens
acauaguagguuggagcaaaaguaauugcaguuuuugccauugaaaguaaugucaguuacuuuugcaccaaccuaauacaaaccaucccauaucugugu

SEQ ID NO: 2248186 - RNA, 61 nt, Homo sapiens
guccauggagacacauuuuauauauaagauacauuucaguauauagagugugucuguggau

SEQ ID NO: 2248187 - RNA, 66 nt, Homo sapiens
caguaugucuuuugcuugcaaauagauugcucauugccaacugcuuccaagaaagagauagggcug

SEQ ID NO: 2248188 - RNA, 86 nt, Homo sapiens
aacuuugccaggcuuggugaugcaugccuguagucccagcuacuagggaggcuaagguaggagaaucacucaagccuggggagguu

SEQ ID NO: 2248189 - RNA, 60 nt, Homo sapiens
uucacccugguuguagauggacucacaggcuucagcuggccaccuaagcucagggaugga

SEQ ID NO: 2248190 - RNA, 61 nt, Homo sapiens
ucuagccauuaaucuugcauccaucucaaauccaguaugagaugcaagauuagauggggga

SEQ ID NO: 2248191 - RNA, 67 nt, Homo sapiens
uuuaacaaacauccagauaaacaaaugugcauaaggccugggagcauaagauggaguguuuguuaga

SEQ ID NO: 2248192 - RNA, 78 nt, Homo sapiens
uggucugcauucaugguuuuauaacccucuugcccaauuuuuacaucuagcaaagagaaauauaaaaccauuugacca

SEQ ID NO: 2248193 - RNA, 57 nt, Homo sapiens
uuaaagugcuguuuuugccgggggcaguggcucaggccuguaaucccagcacuuuag

SEQ ID NO: 2248194 - RNA, 82 nt, Homo sapiens
cguguguguguguguguguguauauauauauauauaugucuacauauacagguaugugucuauauacauguauacauauaug

SEQ ID NO: 2248195 - RNA, 114 nt, Homo sapiens
agagauagcaagccccaacccacagcaucacagcacaggcaugagugucagcaccuucccucugagcuccauccuugcuugcuguaauguugcuauuugaauuauuuguucucu

SEQ ID NO: 2248196 - RNA, 84 nt, Homo sapiens
cuuaauccucaaaguuggaauguauggcaucuugcguuuuuaggacugaauuugccuagaauauauuucuaauuacagauuagg

SEQ ID NO: 2248197 - RNA, 64 nt, Homo sapiens
guuguucaggagguuggggaugcagugagccauguuuguaccaccgcacuccagccugggcaac

SEQ ID NO: 2248198 - RNA, 109 nt, Homo sapiens
uugaaaugugaaagggacaugagauuugggaggggccagugcagaaucauaugguugccuuuguguccccacccaaaucucaucuugaauuguaauccacacaugucaa

SEQ ID NO: 2248199 - RNA, 100 nt, Homo sapiens
guagcugauuuuuucccucugucuuaaagcucauuaauuagaagcuaacuucccccaguuguagcuuuuuaaugugcugcuuuagaagagcuuucacugc

SEQ ID NO: 2248200 - RNA, 75 nt, Homo sapiens
uggcaggcagaugagguccucagcugcuggcccagccuggcagggcggcugcagcccucaucagcccucgcgcca

SEQ ID NO: 2248201 - RNA, 68 nt, Homo sapiens
gggccuagcaggguccaaugugaggcagcauuacccugugcuugcaacacauugccccugcucugccc

SEQ ID NO: 2248202 - RNA, 86 nt, Homo sapiens
ggaucuuauuuuugccaucaauuuaucuauguaacaagugguuuauuuauucauuggaugucugaaaugauuuaagaaugagauuc

SEQ ID NO: 2248203 - RNA, 77 nt, Homo sapiens
ucggauaaucucagagauaucuguguccuacacagcaggguucuguaaggggcacauggauaccucugagaagcuga

SEQ ID NO: 2248204 - RNA, 60 nt, Homo sapiens
ucaaugcguuaggagccugcacacucccuccccgagacuccagugcaccuggcguguuga

SEQ ID NO: 2248205 - RNA, 84 nt, Homo sapiens
cagggcuguguagugcaaugagaaggggcucuggagccaaacacagccagguuccaacccugguuccuucauuuuccaguuuug

SEQ ID NO: 2248206 - RNA, 73 nt, Homo sapiens
cagacacguggagaugguugacaaauguugcccgaaaauuugggaucuuggcaaucaauucugacgucuucug

SEQ ID NO: 2248207 - RNA, 78 nt, Homo sapiens
cuaacaccagugauaaggaucuccauucucacaaguucuauucaacauuguccuggagguucuugcaagggcaauuag

SEQ ID NO: 2248208 - RNA, 96 nt, Homo sapiens
aaguauugguuuugugaauaugagagcugacuuuaaggcaauuuaaguuaauggauuucuugauucuaggggcucucuuauguuaaggucaaacuu

SEQ ID NO: 2248209 - RNA, 128 nt, Homo sapiens
agugcucuauuuuuuaaaaccuguacugacucauuuaauuaucauggcaagccuaugaaauagcuacuauuauuaucacaguuuugcauauggguaaaugaaggcacaaaagggaaaaauagcuugcu

SEQ ID NO: 2248210 - RNA, 66 nt, Homo sapiens
uguagcuucuccuuucauucccuguagaaucugucuuguucucauggagucaggagcagaaauaca

SEQ ID NO: 2248211 - RNA, 56 nt, Homo sapiens
ugaauagugcugcaauaaacauaugugugcaugugucuuuauagcagcaugauuua

SEQ ID NO: 2248212 - RNA, 63 nt, Homo sapiens
cuauguguccauguguucucaucauuaagcucccacuuauaagugagaacaugugguauuugg

SEQ ID NO: 2248213 - RNA, 102 nt, Homo sapiens
uugccuugucaucuuaguguuucuguaucaugcugucgguuuuucuuaaaugucuggugacuggccauugauacagaggucuagauugcuauauuuugguaa

SEQ ID NO: 2248214 - RNA, 67 nt, Homo sapiens
cauaaaugaguagguguuuuauguuuauccuuucccaugggauucccauaaugcuacuuauuuuaug

SEQ ID NO: 2248215 - RNA, 108 nt, Homo sapiens
augaucgccauucuaacuggugugagaugguaucucauugugguuuugauuugcauuucucugauggccggugauggugcgcauuuuucauguguuuuuuggcugcau

SEQ ID NO: 2248216 - RNA, 113 nt, Homo sapiens
guaacguaaugacuaccauaugguaaggcuucuuggaauacugcaggguagacuuuuccugcaacauccaaugacgccucaucauuuuuggaauuuuucauuuuuuccauuac

SEQ ID NO: 2248217 - RNA, 67 nt, Homo sapiens
uugcgaugaagacaaaacaugcucuuuaaauccauucacagagacauguguuucuuuucauuggcaa

SEQ ID NO: 2248218 - RNA, 66 nt, Homo sapiens
gcauuucccagauuagugauguugaguguuuuuucguauauuugcauaucuucuuuugagaaaugc

SEQ ID NO: 2248219 - RNA, 71 nt, Homo sapiens
aggugaugaaugaccuggaugaaugggcuuagaagagggaaaaacaaauaucacaggucaaaucauuauuu

SEQ ID NO: 2248220 - RNA, 86 nt, Homo sapiens
ucuagagcaagaaugagaaggauuaauuaauauugaauagcauaaaaaaauuaaaucuuaguuugacuugacucauuuugccuggg

SEQ ID NO: 2248221 - RNA, 55 nt, Homo sapiens
uaucaugggggguguacacuccaauaucauuggggguguaccucccccugugaua

SEQ ID NO: 2248222 - RNA, 123 nt, Homo sapiens
gaugacauuggcacuaugacagccuaucaaaaaugucaugaguccaaccagaaaauauuugauuugguuucuggagacucagacgccacugauuaggauuugcucauugguguuuuauucauc

SEQ ID NO: 2248223 - RNA, 67 nt, Homo sapiens
gaguaaggggaaauaggccucuauuccucuuguugccugugaagccagguuguguuuccucuuacuu

SEQ ID NO: 2248224 - RNA, 75 nt, Homo sapiens
acuggggcugcugccuuuuuuucagagaugcccuucccagagaggagggaucuagagaggcagucuggccgcagu

SEQ ID NO: 2248225 - RNA, 57 nt, Homo sapiens
uuacagucaccugggggacauauuaaauaccugggauccaccccuuggagacuguga

SEQ ID NO: 2248226 - RNA, 67 nt, Homo sapiens
aacaucuugucuaaugucagcuaccaccaccucaauggggcacaccuuuggcauuuagacaagaguu

SEQ ID NO: 2248227 - RNA, 60 nt, Homo sapiens
uugugcaugaugcauacauggucgcccaguuaaggugaccacaaucuuauauuaucacaa

SEQ ID NO: 2248228 - RNA, 73 nt, Homo sapiens
uuacuagaaucuagaauccagaaauacaguacuguguccuugaggaauacaguguucugggaagaaguaguaa

SEQ ID NO: 2248229 - RNA, 66 nt, Homo sapiens
cuggaggggaccuugggacaagggcuucuuugguagcccuggccagguucacaggcuuccuuucag

SEQ ID NO: 2248230 - RNA, 69 nt, Homo sapiens
ugcagcugaaauugagauuuagguaaaugcuucugcuuugguuaucaucauuucagcaaccacacugca

SEQ ID NO: 2248231 - RNA, 55 nt, Homo sapiens
ccuuggcacuuugccacagugcccgguggauggagcgguguggggugugccaagg

SEQ ID NO: 2248232 - RNA, 59 nt, Homo sapiens
auauauacuugcauauacaccuaggaguagaauugcuagguuauuugguaaauauaugu

SEQ ID NO: 2248233 - RNA, 71 nt, Homo sapiens
guucaucaagcuggcauauguaguucuuaacaaacacauuaaggaaacauucggaaugucacuugcagagc

SEQ ID NO: 2248234 - RNA, 58 nt, Homo sapiens
gcaaaaggugauugcacuagcuucacauuaaaaagucacagugcaauugccuuugugc

SEQ ID NO: 2248235 - RNA, 71 nt, Homo sapiens
uguauuagaguggguaguuaggcaggcaugagcugauagucaagugauuguuaaacugccucucuaaaaua

SEQ ID NO: 2248236 - RNA, 78 nt, Homo sapiens
cucugugggcucaagcuguuuaauguuuuauuaaagaaaugacaaauugguaaacauaagagagcugacuccauaggg

SEQ ID NO: 2248237 - RNA, 76 nt, Homo sapiens
ugacuuacuugaguagaaguaugucaguaucucuccgaacaaaguugaugccagaacucucugcucaugugaguca

SEQ ID NO: 2248238 - RNA, 59 nt, Homo sapiens
ugugcaucagaaagacaugaguuucaaccccagauccuccugcugucuguuugggcaca

SEQ ID NO: 2248239 - RNA, 128 nt, Homo sapiens
ggaggauuuuaucuugccaucauucuguuagcugguuguuauauagacuugauuguauacuuguuuuauauuuucagugggcuauguaauuaacugucuguuucugugguggcagguaauggucuuuc

SEQ ID NO: 2248240 - RNA, 62 nt, Homo sapiens
gaugagguaguguaccuagucuuagaguuugcaaaugauagacacaggauauacaccugauc

SEQ ID NO: 2248241 - RNA, 73 nt, Homo sapiens
agguggagguaccacaguugcucacggguucaccuguggaugggcaugugggcuguugugagugaagccacuu

SEQ ID NO: 2248242 - RNA, 57 nt, Homo sapiens
uggucaguugugccucaauuccaaagggaggaugguauaaugaggcaugucugacua

SEQ ID NO: 2248243 - RNA, 98 nt, Homo sapiens
ugcuuccuuagaacagucuccccauccuuuagacuguccaguugaguuucuagaauuccagcucagggcugaaggcuggggugguuauugagauggca

SEQ ID NO: 2248244 - RNA, 130 nt, Homo sapiens
uguaaauuuaauguauuagguacacauuacacaguuuuaguacguaguaagaauucuuuuagucauuuugauuguacuaaaauuguacuauaauugaaguacuuaagaaaucaaguguguuaaguuuaca

SEQ ID NO: 2248245 - RNA, 98 nt, Homo sapiens
gcaguggaaguggcugcaagagcaacaguggcaguggugggaccccuuugcccagcguccccugugcccuguguuccugaggcagccgacucugcugc

SEQ ID NO: 2248246 - RNA, 57 nt, Homo sapiens
aucacagcccuccucuuggaugucuccacaucagggccucaggaugaguguuguggu

SEQ ID NO: 2248247 - RNA, 67 nt, Homo sapiens
cuccuuacuguacaccuacagaaaaggagaguugguggaggcucuccuguagguguacaguaaggag

SEQ ID NO: 2248248 - RNA, 74 nt, Homo sapiens
gcucuauaggauggaaaucauagccugauuaagacauaaaaccgacaguccccgggcaaaucuuuauccuaagc

SEQ ID NO: 2248249 - RNA, 73 nt, Homo sapiens
ucuugggauuugcuuugaccaauagaaugccacuaaagugauguuauguuaguuacaaggcuagacgucaaga

SEQ ID NO: 2248250 - RNA, 70 nt, Homo sapiens
uugagguucgcauuaugagcauuuauuaagaugguauaauacuuuaaguguaaguggugugggacaucaa

SEQ ID NO: 2248251 - RNA, 67 nt, Homo sapiens
auguuccugugauaguuucuguuuugaagaugaaugccuguuaucacagaggguauccuagagauau

SEQ ID NO: 2248252 - RNA, 109 nt, Homo sapiens
cuguugcccaggcuggagugcaguggugugaucuuggcucacugaacccucuuccucuuggguucaaguaguucucaugccucagccaccccagaaccuggaacuacag

SEQ ID NO: 2248253 - RNA, 76 nt, Homo sapiens
ggcaugaguucugggaagguugguucugccaaacauucauaugcguagagcacauuaucauuuccaaagcuuggcc

SEQ ID NO: 2248254 - RNA, 62 nt, Homo sapiens
uucauuauguuaauuugacauaucauguuuauugguuugauaugucacuugaucauggugaa

SEQ ID NO: 2248255 - RNA, 56 nt, Homo sapiens
ccuuuccuguggcaaggacuggagggggugucuuucacagucuccucuagggaggg

SEQ ID NO: 2248256 - RNA, 64 nt, Homo sapiens
augagaagugacgcagcaggguuuucagcugauggaagcucuccauuuuaugucugcuucuugu

SEQ ID NO: 2248257 - RNA, 72 nt, Homo sapiens
ugcuaccauucaucauuaguuguggaauucuugaaacucaaaaacuucagaguaucuaacugauggguagca

SEQ ID NO: 2248258 - RNA, 64 nt, Homo sapiens
gauuuuauguuuguucccugccaaagggacuaaaauauccccuugagagaucagccauaaaauu

SEQ ID NO: 2248259 - RNA, 67 nt, Homo sapiens
cauaaauuuuagagguccacaggcaaaauauuaugguuugaauauuugugucccucuagaauucaug

SEQ ID NO: 2248260 - RNA, 73 nt, Homo sapiens
guuagggaggagucccucuuuuucuguuguuuggaauaguuucagaaggaaugguaccagcuccuccuuguac

SEQ ID NO: 2248261 - RNA, 129 nt, Homo sapiens
ucugcauggcuggggaggccucaggaaacuuacagucauggcagaaggcaccucuucacaggacagcaggagagagaagugccuucugcugugaacguaaguuuccugaggccuccccaaccauucaga

SEQ ID NO: 2248262 - RNA, 57 nt, Homo sapiens
guggguaaaucucuggggcucucagaucugaaggcugugagaccccugauuucccac

SEQ ID NO: 2248263 - RNA, 63 nt, Homo sapiens
ggaauaaaucccacuugauugugguauauaauuauuuguaucacacuguuggauuugauuucc

SEQ ID NO: 2248264 - RNA, 64 nt, Homo sapiens
gugugaugaggaaguuuacaaagcaucugucugaaauggauaauuuugagaauuuuccacacau

SEQ ID NO: 2248265 - RNA, 81 nt, Homo sapiens
uuuucauuuaugucacuugguuuggugcuacacauagaucaaaggcuuuggauagcauggauaucagcgacaguuugaaga

SEQ ID NO: 2248266 - RNA, 84 nt, Homo sapiens
ucugggcccuuaugaagcucaagacagaagggacacauauagauaguauugaaaguuucaauucuugaacuucauaggucuaga

SEQ ID NO: 2248267 - RNA, 78 nt, Homo sapiens
gagucacguuaauucucuugguuuugcugcaauguauuaugacucugucaggaggguccagagaaaacaaugugauuu

SEQ ID NO: 2248268 - RNA, 63 nt, Homo sapiens
gugcugcuggaacauauuauuuuuguucuuaaaauggacaagacuucuuguauucuaguucac

SEQ ID NO: 2248269 - RNA, 57 nt, Homo sapiens
agggaugggcuaguaaagacaaacuucacacugacugugaaacucagacucauccuu

SEQ ID NO: 2248270 - RNA, 74 nt, Homo sapiens
ugucgggcuugcaccuugaagccaauagcagaauucuaggugcugcaauugggaauaaggagcugugcucgaca

SEQ ID NO: 2248271 - RNA, 61 nt, Homo sapiens
augagggcguauccuucauuaagcgguuagcacaucuucuuggugauaaguaaguucuuau

SEQ ID NO: 2248272 - RNA, 55 nt, Homo sapiens
uuucuacuccucauggcagguuguuuuuaaaagauuacauucagaggaguggaag

SEQ ID NO: 2248273 - RNA, 60 nt, Homo sapiens
aguuguagcaagacuggauggcugaugaccuagauucuggccccaguuuuucuauuagcu

SEQ ID NO: 2248274 - RNA, 82 nt, Homo sapiens
cuuuaggggguauauuuucuggaacuaugccugauagcaauucugcagcaaucuggauagucaggagauauauaccagaaag

SEQ ID NO: 2248275 - RNA, 67 nt, Homo sapiens
auggaucugauaugugcuaaugcuuaauaacuaaucaucuagaguaaaguacucaguucaguuccgu

SEQ ID NO: 2248276 - RNA, 65 nt, Homo sapiens
cuacaguaugaaaccuuuacucucuauacuaugcaugauauaauggaugagggguucguauguag

SEQ ID NO: 2248277 - RNA, 82 nt, Homo sapiens
uuuugaaauguuuuguucuugaguugggaguacaaaguguccagcacuugguauucuuauccaggaaugagcauuuacaaaa

SEQ ID NO: 2248278 - RNA, 73 nt, Homo sapiens
gcuggguaagguggcuuaccuguaauucaagcacuuuggaaggcuugaggugggaggaucacuugagccuagu

SEQ ID NO: 2248279 - RNA, 55 nt, Homo sapiens
gcuggagagcauauaucaccaggauaugauaucuaggagguguuggauuucuagu

SEQ ID NO: 2248280 - RNA, 105 nt, Homo sapiens
gggaaaagugcaguauuugagugggagugucccguuuuuccagguacagucugucauggcuucccuggcuaggaaagggaaauuccccgaccccuugcacuuccc

SEQ ID NO: 2248281 - RNA, 83 nt, Homo sapiens
uaaggcaguuugacuguggagucgaugcuuuuaaccaguguaccaugcugcccaagcuuucugaccuacaucacuucuccuua

SEQ ID NO: 2248282 - RNA, 61 nt, Homo sapiens
uuauuuuuuagucagucuagcuagagauuuauuaauguuuagcugaucuuuuaaagaauga

SEQ ID NO: 2248283 - RNA, 78 nt, Homo sapiens
cccuaaaauaacauucuaaacuauccucuuccagaugcuuguuggcaaaggcaaguauguuuuaggaugcuauuaggg

SEQ ID NO: 2248284 - RNA, 57 nt, Homo sapiens
cuuggcuccgacuccccuccaagaucagagcaguugcuggaguggagagaggccagg

SEQ ID NO: 2248285 - RNA, 58 nt, Homo sapiens
ugacauuuuucuuggauuuuguguaauuguccuaucaauugccgagagaaagguguua

SEQ ID NO: 2248286 - RNA, 58 nt, Homo sapiens
gugaaguuuuuugcugagagucccucugcgugguggccucugugguauagaacuucau

SEQ ID NO: 2248287 - RNA, 55 nt, Homo sapiens
aucagugcauguuuguugagcuaaacuuuuaucucaccgacgaggcugcacuggu

SEQ ID NO: 2248288 - RNA, 119 nt, Homo sapiens
auuauaaugaugaugaucuauaccauuuauuaagugcguacuguaugccaggugcucuucuuggcccuucauauaacagcagcaguggcaguuaauauuuguggaaauuacauuauagu

SEQ ID NO: 2248289 - RNA, 71 nt, Homo sapiens
acaugaccagaaaacaaauuaguuuccauuuucccacauccucuggguacaacuugcauuuguggucaugu

SEQ ID NO: 2248290 - RNA, 114 nt, Homo sapiens
aggcuguacaagucucacauuucuuguucaugauucauguugaugcccaugggaaaguacccuuugaggaugagcaucaccagaaucaauaagcugaucagacuugcacugccu

SEQ ID NO: 2248291 - RNA, 58 nt, Homo sapiens
uggugaacgagauggacaaaaccugucuguuaaccacuuuguccaccuguguucacca

SEQ ID NO: 2248292 - RNA, 74 nt, Homo sapiens
cccuuuuaugacuauugcacuuuccugguacagaugagggcuucuacuaggaagguggcagugaggagggaggg

SEQ ID NO: 2248293 - RNA, 71 nt, Homo sapiens
auguagcuauaguuauuuuuaauccuuuuguauuuuuacucuuacacuggaguuaaaggugauuucugcau

SEQ ID NO: 2248294 - RNA, 74 nt, Homo sapiens
gucuuugucuuuguguuguugguguauuugccucuuuuccugugccagauacaaagcuacucgagggcagggau

SEQ ID NO: 2248295 - RNA, 69 nt, Homo sapiens
augguggcugggauaggauucuacugucagcugucacuucucagugcauccauguucagcagucaccau

SEQ ID NO: 2248296 - RNA, 80 nt, Homo sapiens
guaauguuauguuauguuauguuauguuauguuacguuacguuacguuacguuacguuacguuacguuacguuacguuau

SEQ ID NO: 2248297 - RNA, 130 nt, Homo sapiens
ccucccaaaaugcugggauuacaggcaugagcugacuucugauugaaaauggaguagcccauuccucccagguccucccuuucacaauuaaaaauuacugaacagccugcaaucccaacacuuugggaug

SEQ ID NO: 2248298 - RNA, 76 nt, Homo sapiens
ucuguugaagaggcaguaauuggaagagcugagaucugaacacaugcuuuuccaguuggaaagccuguuuucuaga

SEQ ID NO: 2248299 - RNA, 101 nt, Homo sapiens
gaucuggaaaauagcaggaagauaagagggaggugccucagucccgugggcaguuggugacucaggcaccuuccucuuaucugccugugggcacccagguc

SEQ ID NO: 2248300 - RNA, 85 nt, Homo sapiens
uuccucaagauugcuuuggcaauucagauucuuuuauaguuccauaugaauugugugaaaaaugccuuuggaguuuugauaggaa

SEQ ID NO: 2248301 - RNA, 96 nt, Homo sapiens
uuggggaauaaaacugaacugcaguucaguguuggaaugaaucagacuacagagguugcuucauucaacauugaggggcagucaaagguucucuag

SEQ ID NO: 2248302 - RNA, 80 nt, Homo sapiens
cugccagguuuugaggccugauaacacacugagauuaauacauggcucaaugauaguacaaucagccuaugaccuggugg

SEQ ID NO: 2248303 - RNA, 67 nt, Homo sapiens
cuccuuacuguacaccuacaggagagccuccaccaacucuccuuuucuguagguguacaguaaggag

SEQ ID NO: 2248304 - RNA, 80 nt, Homo sapiens
ggguacagaggagguggaauuccaggaauugagggagcaaaaccauggcacaguucaaggaauguuggcuucucuggcuc

SEQ ID NO: 2248305 - RNA, 78 nt, Homo sapiens
guauugguguuuggcaaaaagguuugugcagccugagagucaugcguucaaaucuucguuuugccauauccuaguugc

SEQ ID NO: 2248306 - RNA, 55 nt, Homo sapiens
uaugcauuguuuuugguucccaggaguggaauuccugagucauaaacaaugcaug

SEQ ID NO: 2248307 - RNA, 98 nt, Homo sapiens
aaacaaaaauggcauuugaauggaaguuuugugaaaucuguugauucaaagauguuaaucauuuuuaccaugacuuguuuauuuauagccuuuuguuu

SEQ ID NO: 2248308 - RNA, 58 nt, Homo sapiens
gucuuggcuucuuuauguggcuauagggccccggguagccaugcagaaggccugagau

SEQ ID NO: 2248309 - RNA, 105 nt, Homo sapiens
cugacgugagagaaucgcuugaacccgggaguuggagguugcagugagccgagauugcaccauugcacuccagcuugggcaacaagagugaaacucuugucucag

SEQ ID NO: 2248310 - RNA, 90 nt, Homo sapiens
cugagguuacucaggaagucagaggcagagcugcagucagggccaccucucuuuacugcuagcugugugcucuuucuacugcacccucag

SEQ ID NO: 2248311 - RNA, 72 nt, Homo sapiens
ugucuaauuuugccuugacacuuacaguccaacaaaaaauuuauaggaaaaauaucacagguaaaguugaca

SEQ ID NO: 2248312 - RNA, 78 nt, Homo sapiens
uagaaagacugagcaucauucacaccuugguccaggcccaugugcauuaccuguccugugaugcaaucuguuuuucua

SEQ ID NO: 2248313 - RNA, 55 nt, Homo sapiens
ccaaagaaucuguagcuggcaggaccaaaggaucugauguuauaaaauucuuugg

SEQ ID NO: 2248314 - RNA, 76 nt, Homo sapiens
uuagacccaaaaaugcuaaggacuuuacuucuaauaguauggaggacacugauagucuuuggcaugaacaguuuag

SEQ ID NO: 2248315 - RNA, 83 nt, Homo sapiens
ugaaacuauaaaacuacuagaggaaaacuugaagacaaugaaugcuucaggacaucacucuaggcaaagauuuuaugaauuca

SEQ ID NO: 2248316 - RNA, 60 nt, Homo sapiens
uggagcuucuguuuuucugccuugcaggguuccugaaggcagguagaauagagacugcca

SEQ ID NO: 2248317 - RNA, 76 nt, Homo sapiens
gauagguaaacuuccacguuugaucaugcagcuggaaaacuuaauagugaauuaaauguuggacguauacauuguc

SEQ ID NO: 2248318 - RNA, 68 nt, Homo sapiens
uggguuguuucugcuuuugggcuauuaugagcgaugcugcuguaaaccucugaguacaagcuuuucca

SEQ ID NO: 2248319 - RNA, 72 nt, Homo sapiens
uuuaccuacuguuuucuuuauaguacagcagauuuuuaaauuaguuuguaauggagcaaacagguuggugaa

SEQ ID NO: 2248320 - RNA, 61 nt, Homo sapiens
aaguaugucuugagacauacuugagacuggguaauuuauaaguauguaucaagucauacuu

SEQ ID NO: 2248321 - RNA, 67 nt, Homo sapiens
ggccaaucuuuccugagugcauuguucugugguuaaaacaagacuuuguauacauggaagaaugguc

SEQ ID NO: 2248322 - RNA, 58 nt, Homo sapiens
ccaccacugaggcacaggagccaaaggcugggcaacagcuuugugccugagaaggugg

SEQ ID NO: 2248323 - RNA, 56 nt, Homo sapiens
uugcagaagaguucgaucuggcagugguauaucugucauaagcucaacaucuguag

SEQ ID NO: 2248324 - RNA, 58 nt, Homo sapiens
cuucccuuucuuaaagaguuaggcagugauauacaugucauuuagaaguaaagggagg

SEQ ID NO: 2248325 - RNA, 86 nt, Homo sapiens
ugccacuggguuguguccccaugcaguuggucagagucccuucagagugguggccuuggcaauggcuggggcugaaacaaguggca

SEQ ID NO: 2248326 - RNA, 63 nt, Homo sapiens
ccauguguccauguguuuucaucauuuagcucccaguuauaagugagaacaugugguauuugg

SEQ ID NO: 2248327 - RNA, 77 nt, Homo sapiens
gggggucuguugaaguguuuauuuuggccuucccaugggugaaggcccagcuugaaugcugcccaugagagaccccu

SEQ ID NO: 2248328 - RNA, 58 nt, Homo sapiens
ccccagugguugcaacagcagaggcuuauugcuugcugugcugugugucuacuguggg

SEQ ID NO: 2248329 - RNA, 62 nt, Homo sapiens
ggguacuaguuaacaauucaaagaccaguguaccuauacacuggaaguguacaauuauaccc

SEQ ID NO: 2248330 - RNA, 100 nt, Homo sapiens
cccaacuaaaaaauacagauuguacagguugccagugaacucugauuagggauauuuauuaauuuacuuucauaggucacuguaaccucgugcucuuggg

SEQ ID NO: 2248331 - RNA, 87 nt, Homo sapiens
cccauaaaugcuggaaaauauucaucuauauguaucauucuuucucaaagauggcacuacugggaaugucuucaguacaauugaggg

SEQ ID NO: 2248332 - RNA, 73 nt, Homo sapiens
aguauauccaugaucuagaguaggaaacagagguccagggacuuguggcacccaucuagacagggguagaacu

SEQ ID NO: 2248333 - RNA, 78 nt, Homo sapiens
gacuuggaugucuggcaccauuuugaucaaaggcucaaaccugugccucuugacucugguguccagugcugggaaguc

SEQ ID NO: 2248334 - RNA, 82 nt, Homo sapiens
uguuuaggcaagagugacuacgugaaagaaauauuuuagggcgagcaaauucuuuuaaaggauacucuugucuacaaagaca

SEQ ID NO: 2248335 - RNA, 106 nt, Homo sapiens
cuuauggagaacauauguguguuagauaagcuucgcuuaggccugaguuauagcgcuguagacugugaguucaauguuaaugaagcaacaauguauguuaaauaag

SEQ ID NO: 2248336 - RNA, 57 nt, Homo sapiens
uucaagcuucuugaugagcaucauaccgaugugugccuucuaagaaggagucuugaa

SEQ ID NO: 2248337 - RNA, 59 nt, Homo sapiens
uuuaagacggaaugcuuuuaacagcacccgagucacauguuaagugcuuucugcuuaga

SEQ ID NO: 2248338 - RNA, 88 nt, Homo sapiens
ggguugguuccaagucuuugcuauugugaauagugccucaguaaacauacgugugcauacgucuuuauaguagcaugauuuauaaucc

SEQ ID NO: 2248339 - RNA, 85 nt, Homo sapiens
gugaaauaagaaauggacauguuugacaagguuucauuuaaaaaaggaugagacccuguauguguuuaguuuucugcuccgucac

SEQ ID NO: 2248340 - RNA, 83 nt, Homo sapiens
cugcucuugaacccuguuuucuguuguuuaagauguuuaucaagacaacaccugcacagccgaacauagacccuuauuaguag

SEQ ID NO: 2248341 - RNA, 91 nt, Homo sapiens
ccugcauccagucuguguccuccugucuuucucauccaggucaggcauugacacuuuguaagaaaggggguaggggacacagcugggcagg

SEQ ID NO: 2248342 - RNA, 118 nt, Homo sapiens
guuauuagcuauaagucaaaacuugcauagaguuauugcccuuuaagggcaaacuugcauugacuuauucccccgaaggacaguagcuuuaugcagguuuugacuuacaucuaguaac

SEQ ID NO: 2248343 - RNA, 65 nt, Homo sapiens
gugacuugaggcucgcacaaguucuucaaacagcuugcgguggaacauggcugccucagccucac

SEQ ID NO: 2248344 - RNA, 66 nt, Homo sapiens
accuauggccgaaugugaaguguuggcggaaccccgcuccggcagcgugcacuuucgccacuaggu

SEQ ID NO: 2248345 - RNA, 73 nt, Homo sapiens
aaaggauaagaacagaaguuuccacgcagcuaucacucaacugccuggaaacuuauguucuucuguguucuuu

SEQ ID NO: 2248346 - RNA, 71 nt, Homo sapiens
ugucaagguacuuuuacaauuucccacugauaacuccauacaacacagggugaaauucaaggaccuucaca

SEQ ID NO: 2248347 - RNA, 60 nt, Homo sapiens
aggguggcgagaaucacauucuaauuuggaguaaagaaaucagaagaaauuccguccccu

SEQ ID NO: 2248348 - RNA, 56 nt, Homo sapiens
cuauuaaacacacugcccauguagaacauaaguaagugcacaguaguguuuaauag

SEQ ID NO: 2248349 - RNA, 126 nt, Homo sapiens
gugugugucuaauuaaugaggguagagguuaaaaaauauuuguugaauaaauuaguauuaacauuuuuauugcuaauaugcuucaggcaaaacuauaggcccugaugauacaauaacaaaauacac

SEQ ID NO: 2248350 - RNA, 59 nt, Homo sapiens
uauuugggcuuuuaaucuagagcagagauuagaaaacuuugccuauaaagggccaggua

SEQ ID NO: 2248351 - RNA, 71 nt, Homo sapiens
cacagcacuaugcuuguguuggggcaguggauaaugagaaaucucuguaccucccacucaaguuugcugug

SEQ ID NO: 2248352 - RNA, 57 nt, Homo sapiens
ugggcugagaguaccuuauaaacagggacagugugucuuaaaaagugcucaggccua

SEQ ID NO: 2248353 - RNA, 113 nt, Homo sapiens
acaaagugugcccuguguauuaauaucagccaacagugcuucauucacacauugcaugacuauugaugucuuaaucuguggagguacugagccaguguggggcauaugauugu

SEQ ID NO: 2248354 - RNA, 84 nt, Homo sapiens
gcuuguucuaaacgugaauucaccugacucccugaaagaacauucucuuucauggaacaaguggguucaaagcacagaguaagc

SEQ ID NO: 2248355 - RNA, 61 nt, Homo sapiens
ucuugauauguagguggcaagcauaucaauuccugauauguagcuugucuacauaucaaga

SEQ ID NO: 2248356 - RNA, 71 nt, Homo sapiens
aauugugauaggaaauuuagcagcgauauaguauucuuaucaaauauacagucuguuagauuuccucaauu

SEQ ID NO: 2248357 - RNA, 59 nt, Homo sapiens
cuuaccagucuagggcucaguuucuucaucuacaaaggaagggaguugggcuaggugag

SEQ ID NO: 2248358 - RNA, 67 nt, Homo sapiens
uuguuauacuuggauauuggucagagacuaaauuauuuuguacucucaccguaucccagauuugcag

SEQ ID NO: 2248359 - RNA, 58 nt, Homo sapiens
uagaccaauuggcauauaguaaucagaguuacccugaaauauuuuggccaauuguuua

SEQ ID NO: 2248360 - RNA, 72 nt, Homo sapiens
gaggacaacauguuuuggaauagaucauuucaauuauugauuuuugauguauuauuaagaccuggcgucuuc

SEQ ID NO: 2248361 - RNA, 73 nt, Homo sapiens
cauggcccuggguccauaggaagccugccauggucacacaacagcugccuaguccuauggaagccagacugug

SEQ ID NO: 2248362 - RNA, 61 nt, Homo sapiens
auaucaguauggauucauggauuccucuuguauucaaugaguuauaaucugcuacugauau

SEQ ID NO: 2248363 - RNA, 104 nt, Homo sapiens
guugugggagggaaggaggugacgcagcaaucuauuugcaccuagaaauuuuaggcaagugauagcugcguaaucauacugcggcaccguuuuuuucuugcagc

SEQ ID NO: 2248364 - RNA, 90 nt, Homo sapiens
gcucucuguuuacugugcuauguuguuuuggccgaagccuaugaagaaaauuuggccucacaaagcuacauaguuggaaaggagagaagc

SEQ ID NO: 2248365 - RNA, 60 nt, Homo sapiens
caggccuggccucuguaacuaaugcaauggcauauugcagaaaugacagagcgccgucug

SEQ ID NO: 2248366 - RNA, 59 nt, Homo sapiens
gauagcagaccaccucucccacugggagcuccaucccagggugguuugaaacuguuguc

SEQ ID NO: 2248367 - RNA, 130 nt, Homo sapiens
uacaggcaagagccacugugcccagccuuauaagguauuuuugucuauaucuuauagauagaaaaacuaauguuuagaaagauacuuaaaaguccuuaagauaggccaggcacaguggcucaugccugua

SEQ ID NO: 2248368 - RNA, 89 nt, Homo sapiens
ggagaaucacuugaaccagggaggcagagguugcagugagccaagguugcgccauugcacuccagccucggcaacaagaaugaaacucc

SEQ ID NO: 2248369 - RNA, 64 nt, Homo sapiens
cagacaugggacauagauccuugagguuucuggugaaaucugcacaucuguguuuuuguaucug

SEQ ID NO: 2248370 - RNA, 101 nt, Homo sapiens
ugaggcacgagaaucgcuugaaccugggacguggagguugcagugagcugagaucaugccauugcacuccagucugggcaacagagugagacucagucuca

SEQ ID NO: 2248371 - RNA, 95 nt, Homo sapiens
guauccaaaccagccugugcacuggaccuugucuucuuuuagucauuaugaagaagccaaccuguccaguaugcaccaggcuuaguuuuaaguac

SEQ ID NO: 2248372 - RNA, 64 nt, Homo sapiens
agcacacauaacacucuucucuagugagcagucucuggugcugacugaguauauguuuggugcu

SEQ ID NO: 2248373 - RNA, 74 nt, Homo sapiens
uagguuaaacacuuauaggccaacuacagcaaaguuuccagaacuguauggcauguauuuuguguauuaacuua

SEQ ID NO: 2248374 - RNA, 69 nt, Homo sapiens
ugagcaucauggggccaaagcgcaagcacccuccuagcagggcagagcgcuggcaccacguggagcuca

SEQ ID NO: 2248375 - RNA, 56 nt, Homo sapiens
ggcugcuauauugguucaggcuugggcacaugacccaagccagaccaauagcagcc

SEQ ID NO: 2248376 - RNA, 77 nt, Homo sapiens
ugcacacaguggucaauggguuguugugacagcuguagggcugcaaucaucgcuguuggccacugcaaaccccugca

SEQ ID NO: 2248377 - RNA, 75 nt, Homo sapiens
ucuacguagaugguuuuucuccgauuuauaggguucucuguuguguaugauggaaaaaaccguaucccaguuaga

SEQ ID NO: 2248378 - RNA, 93 nt, Homo sapiens
gguaucguugcugcagcugguguugugaaucaggccgacgagcagcgcauccucuuacccggcuauuucacgacaccaggguugcaucauacc

SEQ ID NO: 2248379 - RNA, 58 nt, Homo sapiens
ugagacggagucuugcccugucacucaggcuggagugcaguggcacaaucucugcuca

SEQ ID NO: 2248380 - RNA, 78 nt, Homo sapiens
gaauugagauucaucuagguccagagaaaugacuuaauuuaauguaacugucucucacacacuuggguauuuuaauuc

SEQ ID NO: 2248381 - RNA, 59 nt, Homo sapiens
ugucuugggaacgaguuacuccuggacacauuuggugguuugacucaguuucuaaggca

SEQ ID NO: 2248382 - RNA, 74 nt, Homo sapiens
cagagcuacaucacuguuugauugauugauugauugacugacugauugauugauugaaacagggucuugcucug

SEQ ID NO: 2248383 - RNA, 65 nt, Homo sapiens
gaccuagugaguuucagcuggucagagggcccaggucuguugcacacacugaaauacaccuaguc

SEQ ID NO: 2248384 - RNA, 80 nt, Homo sapiens
ccugaauauguugcucuucuccagagcacaaucauuaaaaguaauugagcuggucuuggggaagaguaggguaaaacagg

SEQ ID NO: 2248385 - RNA, 101 nt, Homo sapiens
ugguaaugguauaauuuuggauuauaaacugagauuuguuaguguuagcagacagaccaucaauucacauuuauugucaacagaguauaccaaauuuacca

SEQ ID NO: 2248386 - RNA, 82 nt, Homo sapiens
gggucuaaugguauuucuaguucuagauccuugaggaaacacuacacugacuuccacaaugguugaacuaguuuacaguccc

SEQ ID NO: 2248387 - RNA, 65 nt, Homo sapiens
ugaggaugcagucugucucuuagcagagcuacagcgcugugcuaggagaucugcugcucucuuca

SEQ ID NO: 2248388 - RNA, 94 nt, Homo sapiens
uggccaugcugauugauacucaguguuaaggccaccucuguccaacagacagagguggcuucuacucuguuucagccaaauacucacauggcua

SEQ ID NO: 2248389 - RNA, 63 nt, Homo sapiens
ucucauuuugucuccuaagcugaucacuggagauuccaucguuagugcugaggcaguauggga

SEQ ID NO: 2248390 - RNA, 59 nt, Homo sapiens
cuuuugagcaaauaaaucucaugagaauucacucaguaucaugagaucagcaucaaggg

SEQ ID NO: 2248391 - RNA, 78 nt, Homo sapiens
gcccauacagaugguggucccacagcccacccgcuagaauaccagugccugggcuguggagcaccuuugcagaugggc

SEQ ID NO: 2248392 - RNA, 69 nt, Homo sapiens
cacuugaaccuggguggagguugcagugagcagagauagcgccacugcacuccagcccaggugacagug

SEQ ID NO: 2248393 - RNA, 85 nt, Homo sapiens
gggggauaaagcaagucucuggccucaccccagagauucugacucagcagaugaggccuggaaauaugcauuuauaagguccccu

SEQ ID NO: 2248394 - RNA, 80 nt, Homo sapiens
uuugauuucuucuaauacacgguaugacuuugcucguuuuucauacaaguagacacugaaauguauugaagaguauuaaa

SEQ ID NO: 2248395 - RNA, 72 nt, Homo sapiens
agugaugaauugaacuguaccauggugucacaauuauugaccuugguaauguguuuuauucuuugaaucauu

SEQ ID NO: 2248396 - RNA, 65 nt, Homo sapiens
augauguugggauaacuggcuagccauaugcagaagauugaagcuggaccccuuccuuacaucau

SEQ ID NO: 2248397 - RNA, 125 nt, Homo sapiens
ccugguucaugucauucuccuuccucagccucccaguuagcugagacuacaguaggugccagccacgcugccuggcuaauuuuuuguauucuuaguagggacgagguuucacuguguuugccagg

SEQ ID NO: 2248398 - RNA, 58 nt, Homo sapiens
gcccuggaggcggaggcugcaguaaguugagauagcacuacugcacuccagccugggc

SEQ ID NO: 2248399 - RNA, 95 nt, Homo sapiens
aguuaaggcuauuuucauuucuuuuguggaucuucaguugcuucaggccaucuggauguauacaugcaggucacagggaauaugauggcuuagcu

SEQ ID NO: 2248400 - RNA, 62 nt, Homo sapiens
guaucacguuguuuuggugaaauauggccuuagaguauaguuugaaauagauaaugugaugc

SEQ ID NO: 2248401 - RNA, 67 nt, Homo sapiens
cugagcuagaccacuuggcucccuggcuucagccuccuuuccaggggagugaaugguucugucucag

SEQ ID NO: 2248402 - RNA, 86 nt, Homo sapiens
uaaguucuaggguacaugugcacaacaugcagguuuguuacauauguauacaugcgccauguuggugugcuguacccauuaacuug

SEQ ID NO: 2248403 - RNA, 70 nt, Homo sapiens
uugaggcugcagggaucaugauugcgccacagcacuguagccugggcaagagagcaugacccugucucaa

SEQ ID NO: 2248404 - RNA, 70 nt, Homo sapiens
cagacuggucaagagcaaaggccagggcaacacagaggaugcucaaggcauuuugcuuguugacuuucug

SEQ ID NO: 2248405 - RNA, 59 nt, Homo sapiens
uagcacugucuugcaccugugcuuuccacagaaucccagguauaggucaaugaguguua

SEQ ID NO: 2248406 - RNA, 97 nt, Homo sapiens
gcauacucagcugaauuagaaugacaaggcaauggacuaggauuauauacugagagucacccauggcuucugcauucugucauuuaaaugaguaugc

SEQ ID NO: 2248407 - RNA, 82 nt, Homo sapiens
gauugcuaaagagaauuugcccauuucauucuaacucuaugauuuuuguaucgccugauggggagauucuccuuucauaauu

SEQ ID NO: 2248408 - RNA, 55 nt, Homo sapiens
caaggggagcucuagccuucauaauuauuuuaauugaauacugcugcucccuuug

SEQ ID NO: 2248409 - RNA, 105 nt, Homo sapiens
cugccugucauggagugggagcacaagaaauguuucaugaaauuugaauaaaaguaaaauuaaugaagaccaucugugccucauuuacagagaaugacauggcag

SEQ ID NO: 2248410 - RNA, 85 nt, Homo sapiens
uuuuccaagaauuagccagaaauuccaugucacccauucuggucaguaggauggaagaaacgauuuucuggaaguuucuggaaaa

SEQ ID NO: 2248411 - RNA, 90 nt, Homo sapiens
uuggaugugugugguaguaugugcuaguaucaaacgagacuucgauuuauaggacuuggauugcuacuagauagugaucacagcauccaa

SEQ ID NO: 2248412 - RNA, 76 nt, Homo sapiens
ggucugcagcaaccucaauucuugcuuccucaggagaaaaaauucaacugaaggacauaaggcagagugagagacc

SEQ ID NO: 2248413 - RNA, 80 nt, Homo sapiens
ggaguucuguuguuuggauaauuuaaacacugugaaugucuuugaaauuuuguuuaagugaauuaucuaacauguacucc

SEQ ID NO: 2248414 - RNA, 69 nt, Homo sapiens
ggcccaaguuucgguggaucauuccagggguuaugacgccucucugagaccacuccaaacuccagggcc

SEQ ID NO: 2248415 - RNA, 66 nt, Homo sapiens
ugauacuggcuucauagaaugauuucaggaggauucccucuuucucuauuuuguggaguaguauca

SEQ ID NO: 2248416 - RNA, 59 nt, Homo sapiens
uguccaggcagagguuugcuucaggggcuguauccucauggagaaccucugcuagggca

SEQ ID NO: 2248417 - RNA, 74 nt, Homo sapiens
cuagagauggaaugucuuuuccccaaagcuucaaccagcgguucugcuuggacccagaugacauuguauccuag

SEQ ID NO: 2248418 - RNA, 89 nt, Homo sapiens
uuguaggaaucacugcggaagcaugaggagcacuuagacucaugcccaaugagcuuguggucuucguguuauuguccucaucacugcaa

SEQ ID NO: 2248419 - RNA, 73 nt, Homo sapiens
ggacuggaaagaaucaggcuaaacucuugaguguaauugcuucugauguuuucacccuguuuuuucauaguuu

SEQ ID NO: 2248420 - RNA, 67 nt, Homo sapiens
uggaguucuaacuaguaaagggcagagccauguuuuaaaucauggucuggucccugguuggaaacca

SEQ ID NO: 2248421 - RNA, 82 nt, Homo sapiens
gugggguuuaacaccuaggugauggguugauaggugcagcaaaccaccauagcacacauuuaccuauguaaugaaccugcac

SEQ ID NO: 2248422 - RNA, 60 nt, Homo sapiens
guugggcugaagugugugcuuauaaauguguuuaguuuuuaagcuaaacauucaguuaac

SEQ ID NO: 2248423 - RNA, 58 nt, Homo sapiens
aauacuuacugaguugugaggaccuguaagaaaggucacagcacuuuuaguaaguguu

SEQ ID NO: 2248424 - RNA, 71 nt, Homo sapiens
aguuuugaauccucuaauaugugaugcauagacaucuaaacuauuccacacuguuggugggauugcaagcu

SEQ ID NO: 2248425 - RNA, 62 nt, Homo sapiens
uaguuugauccuaacauccgauguguauucuaauaucuuugguaugaaaaggaauuagacua

SEQ ID NO: 2248426 - RNA, 60 nt, Homo sapiens
ugggaacauggaaauucugcucuguuucagccaaaacagaaaaacaggauuguguuccua

SEQ ID NO: 2248427 - RNA, 91 nt, Homo sapiens
agucaccagaguccauuguauuagucuuauuuucaucaccgugggcguacccugugggaugauguuaaacguacucuagacucuguuggcu

SEQ ID NO: 2248428 - RNA, 67 nt, Homo sapiens
gugagaauauuuuccaugucucaucugcaacugaaaguguguugucucugauggauaaaauucucac

SEQ ID NO: 2248429 - RNA, 100 nt, Homo sapiens
uuucuugacauuauguguggugaagaaguacaagacaaauuuucuagauaugaaaugucuuugaguauuucugcaaagggcuuguuaccauggugagaaa

SEQ ID NO: 2248430 - RNA, 56 nt, Homo sapiens
gacucugucugauuguuucagcacuaugagaugugaaugagaaccucuacagaguc

SEQ ID NO: 2248431 - RNA, 71 nt, Homo sapiens
guggccuaccauguaucugggaugcuuuuagucauggcuggaccuagagugaccgugaugcaguaugccau

SEQ ID NO: 2248432 - RNA, 55 nt, Homo sapiens
uaugugaaaugcaugaacacacagcuguacaugugugcacaugauauaucacaua

SEQ ID NO: 2248433 - RNA, 119 nt, Homo sapiens
cuccugaacggugaucauucuuuuucuaacauuuucugagugcuaaccagguacgaggcauuacuguuagcacaucccuaaaaugcugugggguaggaacuauuauugucacagaggag

SEQ ID NO: 2248434 - RNA, 71 nt, Homo sapiens
ucagaaaugucacauaaguuuugugcuagggccaggucuguggcacaaugacccuugugggcagugucugg

SEQ ID NO: 2248435 - RNA, 67 nt, Homo sapiens
ggcaagaaccagggauuugcgucugagcacaaacuugacugcaggaaugggaagcccuaguucugcc

SEQ ID NO: 2248436 - RNA, 67 nt, Homo sapiens
cagaaaaguggcaagaauguacaaaaggugcugauauagcauucauuucgauuugccaacuguuuug

SEQ ID NO: 2248437 - RNA, 87 nt, Homo sapiens
uaugccccccuccgacuggacuguaauaccaugaggacagagacagugucuuucucauucauuguugcaguccuaaggccuagcaua

SEQ ID NO: 2248438 - RNA, 59 nt, Homo sapiens
gcuuagcaaacugagagccacuaucuauuuuacagagcauggcucuuugcugcuaaagu

SEQ ID NO: 2248439 - RNA, 89 nt, Homo sapiens
guucagguggcuauguagugggugagauccucucuuauauggguccagggguggccugugagaggagggaccucuccugccaauugaau

SEQ ID NO: 2248440 - RNA, 61 nt, Homo sapiens
ucaccaacacuuguuuccuuccaucuuuuugaucaaugacauauuagcagguguuagguga

SEQ ID NO: 2248441 - RNA, 88 nt, Homo sapiens
gucuucucuuucuuuuagcacuaauucguuggggcagaguuaaguccaguccugcgcucccagugguggcugcucugagagagaggac

SEQ ID NO: 2248442 - RNA, 87 nt, Homo sapiens
guggaaggguagaagggcaagagacugcauauaugaaagagcucacuuuuauaacagagacuccugugcuaacaaacccauucccac

SEQ ID NO: 2248443 - RNA, 76 nt, Homo sapiens
ugucauuuggauacaaguuauuugaacugcggugauaugauaucucauuguaguuuugauuugaauuucucugaua

SEQ ID NO: 2248444 - RNA, 64 nt, Homo sapiens
cauucuuguauagguuuuuguaacacaaauuuuuauuucucugugauaaaugccuacaagggug

SEQ ID NO: 2248445 - RNA, 60 nt, Homo sapiens
ggagauguccuaagugguuaacucuauugaaagagucacauaagugcauaggauauuucu

SEQ ID NO: 2248446 - RNA, 96 nt, Homo sapiens
ggcaggagaaucacuugaacuuuggaggcggagguuguggugagcugagauagcaccauugcacuccagccugggcaacaagaaugaaacucugcc

SEQ ID NO: 2248447 - RNA, 59 nt, Homo sapiens
cccaggaggcggagguugcagugagccgaggucgcaccauugcgcuccagccuccuggg

SEQ ID NO: 2248448 - RNA, 77 nt, Homo sapiens
uuucccucgaggaacaaaugcacuucucuuacauaugaaagaugauguguucuguguucccauagaaucuagggaaa

SEQ ID NO: 2248449 - RNA, 64 nt, Homo sapiens
gaucaggaguugauuuuggauauauuauaccugauguuuugauaugucccucgacaucaggguc

SEQ ID NO: 2248450 - RNA, 120 nt, Homo sapiens
uguuagucauguuguauugaguucuuauuaaguaucaggcauuguauuguaauccccacaacaguccugugagguaauuaucauuaguccuguuuuacaaaugagaaaagauggccaaca

SEQ ID NO: 2248451 - RNA, 76 nt, Homo sapiens
cagcaaguuacagaaaccauuuuauucuacagccauugggguacuucaguuuaugggauguuuuuggaaacuucug

SEQ ID NO: 2248452 - RNA, 66 nt, Homo sapiens
agggcuugcacuugaaauuccaguuuguagcuccacagugaaagcuauggguuucaagugggcccu

SEQ ID NO: 2248453 - RNA, 59 nt, Homo sapiens
uggaguuggccacugauuggaccagagaugaguaucugacucagcaguaaucaacuuca

SEQ ID NO: 2248454 - RNA, 58 nt, Homo sapiens
gugacggcagcacugagcugugauagaccccuugcugacuagcucaguguuugcuuac

SEQ ID NO: 2248455 - RNA, 56 nt, Homo sapiens
uccccuuccucccaugaggcuuggggaacuucgaaguucucugguguuggagggga

SEQ ID NO: 2248456 - RNA, 58 nt, Homo sapiens
gugacauuauuucagcuacaugagugaccuuagacucauguggcugaaauaaugacau

SEQ ID NO: 2248457 - RNA, 122 nt, Homo sapiens
aaaagauguuaaugaauuuuuaguaaucauacaauaggaucucaguuuugccuuguuuaagggagagcaucucuuaaccaguuuagaauuguguuagaaucugaaaauuuugcauuucuuuu

SEQ ID NO: 2248458 - RNA, 72 nt, Homo sapiens
aaucauuuaugggaaugacuguguugcuaaauuuaacagaguguaacaauagucaguagucucauaaugauu

SEQ ID NO: 2248459 - RNA, 67 nt, Homo sapiens
gauaagucaauggaacagauuaagaggacagaaauaaacccuuacauuuauagucaguugacuuauu

SEQ ID NO: 2248460 - RNA, 61 nt, Homo sapiens
ugugccaaaccuguaggggccaagagggagauuuucucuucacucacugaagguucacaca

SEQ ID NO: 2248461 - RNA, 68 nt, Homo sapiens
guaaauuaaacucuauaauagcuauguauaaauaagaaaaaauacauaguagauauaggguuuauugc

SEQ ID NO: 2248462 - RNA, 69 nt, Homo sapiens
guggaaaaugucugugugcuguuuuccaugaaucuggauguagagguauagcugcagauauaaauccgc

SEQ ID NO: 2248463 - RNA, 56 nt, Homo sapiens
uuccccacaauaccuguuuacuuuauuauuuauaguacuguaguaauugaggggaa

SEQ ID NO: 2248464 - RNA, 91 nt, Homo sapiens
caugguagcguauaagucucgugagaacuaaugguuugauaagggguuuccccuuucaguugguuuucauucucucuugccugccgccaug

SEQ ID NO: 2248465 - RNA, 55 nt, Homo sapiens
aagcuggagugcaguggugcgaucuugguucacugcaaucucugccucccaguuu

SEQ ID NO: 2248466 - RNA, 64 nt, Homo sapiens
uucaguuagccaguguuuuauugagaauuuuugcauugauguucaucagagauauuggccugaa

SEQ ID NO: 2248467 - RNA, 65 nt, Homo sapiens
uugugguaggcauguaagaugaauagacauguaauuauauauuuauuuuacaaaugcuucuauag

SEQ ID NO: 2248468 - RNA, 90 nt, Homo sapiens
gagauugguggugauauuagugaaugugaugucuugauaauaccuaauagaauaugucaaaauuugcauaauucagugaaccaauauuuc

SEQ ID NO: 2248469 - RNA, 128 nt, Homo sapiens
cuacauaaccuucagcaagucacguaaugucucuaauuucccaaggccaguuuuacccccaccuugguaggacauugcccuuguggagaacagaagauccccuuugcaucugauaagagggcuuguag

SEQ ID NO: 2248470 - RNA, 111 nt, Homo sapiens
acuuauccuacacacacacacacacacacacacacauacacauaugguguauauauguauguguauauauauauguauauguauguguguuuguguguguguaggauaagu

SEQ ID NO: 2248471 - RNA, 97 nt, Homo sapiens
uguucauggaggagaugcagaguauaaguugacucaaucuuuggcaagauuuuuccuucuuuaaaggucaaguuaugcucuguaguauauuuggaca

SEQ ID NO: 2248472 - RNA, 119 nt, Homo sapiens
gagauagaguauguuaaaaugucuagcucagugucuggcacacagaaacaaugaguuacauauauugaauacuuucuauguucuagggacugugcuaagcacucuacauguauuaucuc

SEQ ID NO: 2248473 - RNA, 78 nt, Homo sapiens
ucugagccaccuaaagcuagagcuggaguggcacaagcaacccugcugccacuaaugcuauaacugagcugggucaga

SEQ ID NO: 2248474 - RNA, 129 nt, Homo sapiens
uuucccuugggauauuauaacauaaccugcuuguaaauuugagauuaaucuuuaaguaagaucugucuguaaaucaaaccacaccaguguuacuaagaugaguuucuugcagguuuguccuaggagaga

SEQ ID NO: 2248475 - RNA, 72 nt, Homo sapiens
aucuuuauagcagugugaaaauggacuaauucaguaaauugauagcacagaguggggcgcugcuauaaagau

SEQ ID NO: 2248476 - RNA, 73 nt, Homo sapiens
uccaugugaaaucuaugaggacagcagcaaacacgaaagccaacaugcauuuccuuccuuugauucacuuggg

SEQ ID NO: 2248477 - RNA, 58 nt, Homo sapiens
uaggugaauguaguaagguguugauuagaggugcaaucaacccaagacauuucacuua

SEQ ID NO: 2248478 - RNA, 59 nt, Homo sapiens
cugcuguagguccaagaguccaaaagcagaagaacuuggagucugauguucuaaggcag

SEQ ID NO: 2248479 - RNA, 87 nt, Homo sapiens
ggagaaucgcuugaaccuggaggcagagguugcagugagcugagaucgcgccauuguacuccagccugggugacagggugagacucc

SEQ ID NO: 2248480 - RNA, 82 nt, Homo sapiens
aguucuaggguacaugugcacaacaugcagguuuguuacauauguauacacgugccauguugguaugcugcacccauuaacu

SEQ ID NO: 2248481 - RNA, 68 nt, Homo sapiens
cuguagucucagacuuuugggcucaaagcauccuccaacaucagcuucucaaaguacugauauuacag

SEQ ID NO: 2248482 - RNA, 84 nt, Homo sapiens
uuuagguuuuuuuaguuuugcagaugauacgauaucugagaucauaucuaaaaucauaucaucugcaaacaaagauaauuugga

SEQ ID NO: 2248483 - RNA, 80 nt, Homo sapiens
auacauauacauuugcuuguguggguguacgugugugagagaaggagaaaguauauccauguggauaaauguguaugugu

SEQ ID NO: 2248484 - RNA, 72 nt, Homo sapiens
gcugagguggcacaggguuguuggucauaugauuugcuaucugauggccugaugcaccugucccaccacagc

SEQ ID NO: 2248485 - RNA, 56 nt, Homo sapiens
ucacacugucuugguuacucuugcucugugguacauuuugaaaucaggaaguguga

SEQ ID NO: 2248486 - RNA, 106 nt, Homo sapiens
ggguguccccugugaggcuggggucuuuauggacugggaaggggaagcaaugugcuuaguccgacagcugucuuggagaacucagcuuggcaaggagccuuggccc

SEQ ID NO: 2248487 - RNA, 59 nt, Homo sapiens
ucugaaagagcauuugaaugggugcggcaguccacaccuguaauaucagcacuuugaga

SEQ ID NO: 2248488 - RNA, 63 nt, Homo sapiens
cuguguauccauguguucucaucauuuagcucccacuuacaagugagaacaugugguauuugg

SEQ ID NO: 2248489 - RNA, 63 nt, Homo sapiens
ccuguaacuccuuggcucaagugauccucccaccucagccucuugagcaacuaggguuauagg

SEQ ID NO: 2248490 - RNA, 63 nt, Homo sapiens
aggucucaaaguacuuugguuauugugguacaucagaaugauagcuaguauuuacugagaucu

SEQ ID NO: 2248491 - RNA, 67 nt, Homo sapiens
guggggagaggagagaggacaacaacuuaaauaauaugugagaauuuuggcacucuucucuccuuau

SEQ ID NO: 2248492 - RNA, 60 nt, Homo sapiens
ugguacugucccaguucugucaagcgguccgucaagucugugauagacaucacagugcca

SEQ ID NO: 2248493 - RNA, 84 nt, Homo sapiens
ggaaagcagaagcagucaagcaguuuuacagggcagugcacgcuuuccauguagaugcuauguugucauucauuucuauuuucu

SEQ ID NO: 2248494 - RNA, 56 nt, Homo sapiens
ggagguagguuugugauuuguagccaaacaccagcugaaguuagcauccuaccucc

SEQ ID NO: 2248495 - RNA, 80 nt, Homo sapiens
gcuugcuggagaacuacugcagucuuuuggaggaaagaaggcauucugccuuuuugaguugccagaguucuugcacgggc

SEQ ID NO: 2248496 - RNA, 114 nt, Homo sapiens
caccacuggcuggcuggaauuccaagccagcaggucuuaacuugugaggugcuguggaaguggggcccacagaacaagacugcuuggcucccuggauucagcccccuuuaggug

SEQ ID NO: 2248497 - RNA, 118 nt, Homo sapiens
gaggcugcucacuccauuuggggaaguuuuagccauaggaaguuuucuugcugggccuggaucuguuuuucagagccacacagaaagauuuuccuuucccuacuuggggucuggccuu

SEQ ID NO: 2248498 - RNA, 76 nt, Homo sapiens
ucacuauuacuguacugcucuuaaccugaacaguggaacucagucuagguuaaagcaaguggaguacgagaaguga

SEQ ID NO: 2248499 - RNA, 90 nt, Homo sapiens
ugaaaggcuuuguugguugauuggauguaggaugugaguuauggggccaucauggguuuugguccaagcaacugaauaaugaagucuuca

SEQ ID NO: 2248500 - RNA, 97 nt, Homo sapiens
auacuauguugaauaggaguggugaaaguaggcauuuuugucuuguucuaguucuuaaaaaaaauggcuuucagcuuuuccccauucaguaugaugu

SEQ ID NO: 2248501 - RNA, 70 nt, Homo sapiens
cacuucccuaggagaaguaauuauuugguacaaauuacauuuuuacuuaguagcuuauccugugggagug

SEQ ID NO: 2248502 - RNA, 57 nt, Homo sapiens
gguucugcaggaaacagaacaaggauuaauuauugaugucugucuccgaguagaauu

SEQ ID NO: 2248503 - RNA, 79 nt, Homo sapiens
gucucagguaugucuuuaacagcagcaugaaaacagacuaauacacaauuuucuucugcugggaggcauacuuuaagac

SEQ ID NO: 2248504 - RNA, 68 nt, Homo sapiens
caugcacagaugaggagaggucucaggaagcuuuggcguggucugggaccuuaccucuuuguguaaug

SEQ ID NO: 2248505 - RNA, 93 nt, Homo sapiens
gugauuauuagguucaaauggcacaguaagggcauuuaugccaaagggggugcaaaaugccuuuccugaugcuaucugcugccucuguguugc

SEQ ID NO: 2248506 - RNA, 64 nt, Homo sapiens
ugggggcccagauguuuggggucauggggacccugcuccguccuuguuggcacuggugccccca

SEQ ID NO: 2248507 - RNA, 81 nt, Homo sapiens
gugcauaagagcaaauaguugcaucuuaggucugugaguacgcuaacuggaccaagaagcgacuugaauguuaguaugugu

SEQ ID NO: 2248508 - RNA, 77 nt, Homo sapiens
uucauguaacuguugugagcauucaaggaaggagcugggaaaugguuuagucuucauagaugcucaacagaugugag

SEQ ID NO: 2248509 - RNA, 102 nt, Homo sapiens
guggugaugguuucauggguguauacaugucaaaacucacauauugcauaauauuaaguguguacaguuuauuaugugucaacuaugccucaauaaagcugc

SEQ ID NO: 2248510 - RNA, 75 nt, Homo sapiens
acacauguaccuguauguucauuucacacauguauugcugggaacauguguguacauggcuaugcauacaugugu

SEQ ID NO: 2248511 - RNA, 62 nt, Homo sapiens
agcaaauuguugaucuacaguaagggcugagcagagcagauccuugagaacaucaauuugcu

SEQ ID NO: 2248512 - RNA, 62 nt, Homo sapiens
ucaguuugccaguauuuuauugagaauuuucgcaucgauguucaucagggauauuggccuga

SEQ ID NO: 2248513 - RNA, 59 nt, Homo sapiens
ggggagacagggacagugaucuaaagucuccaguggcauugugaacauuucccugcccc

SEQ ID NO: 2248514 - RNA, 56 nt, Homo sapiens
acaguauggugguagugacauucaacuauccacauauaucacaaccacagugcugu

SEQ ID NO: 2248515 - RNA, 66 nt, Homo sapiens
uagauuuugguuuuuugcaaucauggucacagaacugugagacugaaauuaggaaacugaaauuug

SEQ ID NO: 2248516 - RNA, 62 nt, Homo sapiens
aggaacacuuacauacuguuagugggaguguaaccauuguggaagacaguguggugauuccu

SEQ ID NO: 2248517 - RNA, 72 nt, Homo sapiens
augguauuucuaguucuagauccuugaggaaucaccacacugucuuccacaaugguugaacuaguuuacggu

SEQ ID NO: 2248518 - RNA, 80 nt, Homo sapiens
uuuugguaaaucguguaacuuagugugcuuauaugcaacuuaauuaauguaaagguuuauaaaguaggcuaauaccaaaa

SEQ ID NO: 2248519 - RNA, 93 nt, Homo sapiens
ccagcuggagugcaguggcacaaugucagcucacugcaaccuccgccucccagguucaagcgauucuugugccucagccucccaagcagcugg

SEQ ID NO: 2248520 - RNA, 56 nt, Homo sapiens
uugagauggaguuuugcucuuguagcccaggcuggaguacaauggcgccaucucag

SEQ ID NO: 2248521 - RNA, 73 nt, Homo sapiens
ccagcaaugauucucaaccaggucgaguuugcccucccaggggacauuuggcaacguagggaggcauuuuugg

SEQ ID NO: 2248522 - RNA, 57 nt, Homo sapiens
ugagucgagauugcgccacuguacuccagccugggcgacagagcgagacucgucuca

SEQ ID NO: 2248523 - RNA, 72 nt, Homo sapiens
ggccauuccuaaaccugacagguagcaaagugcacagccacugggaugccugagccagguuuuaggagagcc

SEQ ID NO: 2248524 - RNA, 127 nt, Homo sapiens
cuuaggcuuaggguuaaggguuaggguuagguguaggguuagguuugggcuaaagauuaauguuaggauuaggguuuggguuuuauguaacagcuagguuuagguuugggguagauguaggcuuagg

SEQ ID NO: 2248525 - RNA, 86 nt, Homo sapiens
ugguaaaauauuuugacaagggaaaugcaaaauguuuaaguaauuaugacaaugcuuuuguuuucucuuguuuuaauguuauauua

SEQ ID NO: 2248526 - RNA, 88 nt, Homo sapiens
uucacagccugagucuuaguuuuucauccaaaaagggugguuaacacuuauuucauggaguugagaaggcuaagaugacagaggugaa

SEQ ID NO: 2248527 - RNA, 75 nt, Homo sapiens
aaucaggacauguuccuuuucaucuuugccucccauaauuuucuuugguagaggucuuaucaaacaugcuugauu

SEQ ID NO: 2248528 - RNA, 81 nt, Homo sapiens
ggugaggggaacugaaauggaaugugugcacaguguauuucaaacacauguaugugaauucauuuaaucaucccuuuuacc

SEQ ID NO: 2248529 - RNA, 77 nt, Homo sapiens
gucacucauaaugucuggcacaacauagguuacuugaguuguuacacucacaguacuguuguuugcugccauggugc

SEQ ID NO: 2248530 - RNA, 56 nt, Homo sapiens
uugagauggaguuuugcucuuguugcccaggcuggaguguaauggcuccaucucgg

SEQ ID NO: 2248531 - RNA, 57 nt, Homo sapiens
ugauguaggacauuauuauuucaaaugugcaucacuuuuaugauaauguuugcauca

SEQ ID NO: 2248532 - RNA, 77 nt, Homo sapiens
ccaaguugucauaagccuauuauuucuuuacauuacugaagugaaagacagcauuaauggcuaaaugccauacuugg

SEQ ID NO: 2248533 - RNA, 68 nt, Homo sapiens
uaaugguaucauuacuguuuuauuuggauuuaguuuggauuugaauuucugcuuuaaugguaucauua

SEQ ID NO: 2248534 - RNA, 74 nt, Homo sapiens
ggaaucucacuccuaccacuuaacuaugucacuuaaauuaaccuugugugacugggaguggugaagauaauucc

SEQ ID NO: 2248535 - RNA, 56 nt, Homo sapiens
ugggaggcggaggcugcagugagccgagauuacgccacugcacuccaggcugccca

SEQ ID NO: 2248536 - RNA, 56 nt, Homo sapiens
acuaaaaagcgaggauuccuguacuucccgguggcagguaguuuuccuuuuggagu

SEQ ID NO: 2248537 - RNA, 60 nt, Homo sapiens
gaagucauucagcagcagguuguuuuauuuccauguaauuauaugguugugagugauuuu

SEQ ID NO: 2248538 - RNA, 68 nt, Homo sapiens
ucuuuugcagcuguagaaaggacucaacaaagaaagcuugaagaauuacuuuuagcagcagcaagaga

SEQ ID NO: 2248539 - RNA, 69 nt, Homo sapiens
agggagcagagacccugagcucuuauuuaggcugagcuagaugaguagcuaauguuuacugagcucccu

SEQ ID NO: 2248540 - RNA, 69 nt, Homo sapiens
gcagccugggauuuggagccacuacuggucucugugucuuggugguaguggucuccugggcccagcugu

SEQ ID NO: 2248541 - RNA, 105 nt, Homo sapiens
ucccagucucagguacgucuuuaucagcagcaugaaaacggacuaauacaguaaaucgguaacaguagagugggguguuguugaaaagauaccuaaaacugugga

SEQ ID NO: 2248542 - RNA, 62 nt, Homo sapiens
cuggaaugucagcuacaagagggcagggacuguggcuauuuuguucucugcuacauucucag

SEQ ID NO: 2248543 - RNA, 83 nt, Homo sapiens
caguccuguuucaauguuaauuuccugauuuugauaacugauauuauugagauguaagauguuaauauuaauugagaaagcug

SEQ ID NO: 2248544 - RNA, 118 nt, Homo sapiens
ugaguaccauaacauggcuucacaaucuacacuggcacuguguuuagaugggauuggagccaaauaauucuauuugaauugucacaggcuaaagagaaaaagaauagagauggacuua

SEQ ID NO: 2248545 - RNA, 77 nt, Homo sapiens
aggagguaagggcaugcugcaugagaguaaugccgugaugagugucuuacucugguaaaaugccauuuacaaugccu

SEQ ID NO: 2248546 - RNA, 72 nt, Homo sapiens
aagacagagaaagggagaauucgugcuaucugcuugaccacuuaagcugagacauugguuuucuccugucuu

SEQ ID NO: 2248547 - RNA, 121 nt, Homo sapiens
cuuucugagccuuaauagucaauuuuggucucuuugguuuacuuggugcuagugggccuccugaaauucucuuugugcuggccaccagguuaggccaccuagagucuuuaagcaaggagag

SEQ ID NO: 2248548 - RNA, 61 nt, Homo sapiens
ugugugucagggacggcugaaccucggccugcagccgccacaucaccuugcccugcacaca

SEQ ID NO: 2248549 - RNA, 77 nt, Homo sapiens
gaucaaacaaguucucuaggaaguauaaagguuuuuacucuaauucuuuuggcuuaaagagaauguauauuuagauc

SEQ ID NO: 2248550 - RNA, 71 nt, Homo sapiens
aaauauguauuaugcacacacguguuuaugugugcauauauacauguacagguguguguauauauauauuu

SEQ ID NO: 2248551 - RNA, 92 nt, Homo sapiens
gaggucauucaaugcucucucugaguuucagggaacuuagcaauucuuaaguucauucaugaaacuuaguucugaggguaccagcaggcuuc

SEQ ID NO: 2248552 - RNA, 56 nt, Homo sapiens
uagggcuuuuccaagcugccacuggucggccaguacagccuccggaagcagcccua

SEQ ID NO: 2248553 - RNA, 69 nt, Homo sapiens
uacacacugagguauuuaggugaaagaaggauauuuguaccuuacucuuaaacgauggcucagugugug

SEQ ID NO: 2248554 - RNA, 91 nt, Homo sapiens
gacuaagucucauaucgucugcauauucuagggcaccaacaugauuaaagcuagacaaauuuggguucugaaauauguuuugagucuaguc

SEQ ID NO: 2248555 - RNA, 95 nt, Homo sapiens
gacagagucucgcucuauugccuaggcuggagugcaguagcaugaucucaucucacuacaaccucugccucccagguucaagcgauucuucuguc

SEQ ID NO: 2248556 - RNA, 130 nt, Homo sapiens
auaucagaaucauguggaggauuuguuaggacagauuguuaggccucacccccagaauuucugauucaguuggucugagguaggcccugagaauaugcauuucuaacaaguucccaagugaugcugauau

SEQ ID NO: 2248557 - RNA, 55 nt, Homo sapiens
cagcugaaugaaagguaguuuccucaugaugacuacaacuucuauuauucagcug

SEQ ID NO: 2248558 - RNA, 80 nt, Homo sapiens
ggaacaagggaagcaguuuaggucagggggaaucuaagccaggauucagucuccccuguaaacuggcuucccuguguucc

SEQ ID NO: 2248559 - RNA, 126 nt, Homo sapiens
cuccuggacucaagcaauccgcccaccucagccucucaaagugcugggauuggccaggcgcaguggaucaugccuguaaucccagcacuuugggaggccgaggcgggcagaucacgaggucaggag

SEQ ID NO: 2248560 - RNA, 59 nt, Homo sapiens
aauccuaauauaugccagcacauuuuaauugagaaauggcuauuucaugugguaggauu

SEQ ID NO: 2248561 - RNA, 117 nt, Homo sapiens
uuuuuuacauauaucuuuuuauaacuuuccaggaacuaagcacauuaucugauaauuguuguaaauuuuuuugucagugcuuuaguucaggaugggcaauaaauuauuucuaaagga

SEQ ID NO: 2248562 - RNA, 62 nt, Homo sapiens
uagaauauaucugaggugaugccaggaguuugcauuuuuaguaaacaccucagguaauucug

SEQ ID NO: 2248563 - RNA, 66 nt, Homo sapiens
ugucauugguucuguuuaugugauggaguauguuuauugauuuacauauguugaaccagucuggca

SEQ ID NO: 2248564 - RNA, 81 nt, Homo sapiens
uggauuccgcauucaugaaagccacagguuucuuucuugaucacugaaagcagcaggugguuuucaaugccauugccucca

SEQ ID NO: 2248565 - RNA, 71 nt, Homo sapiens
cuucagaaucuaugugccagcuccaaauagucugcuuacugcaccuggagcuagcauuuagacaucuggag

SEQ ID NO: 2248566 - RNA, 70 nt, Homo sapiens
cuuuccuugucuuguuggcaacacaccaugguuaagucccagcugaggguucccaguaggagaaggaagg

SEQ ID NO: 2248567 - RNA, 55 nt, Homo sapiens
guguuagggucaaauguguugaacuggcaaguuggagcacauuguccucuaacgc

SEQ ID NO: 2248568 - RNA, 80 nt, Homo sapiens
gucauaucuauuuccccauuccuuugaaucugagcgggcugagugacuugcuuugguuaauaggauauggcagaagugac

SEQ ID NO: 2248569 - RNA, 74 nt, Homo sapiens
agccagaaagugucuuggagacauugccauugaauuguucagaaacaauuuuucagacacccacagcuguagcu

SEQ ID NO: 2248570 - RNA, 58 nt, Homo sapiens
cugugagaggauaucaacugauggcaugauugucacuuucaguauauuguuuccacag

SEQ ID NO: 2248571 - RNA, 81 nt, Homo sapiens
cacugauuuuguuucauccacagugucaauguugugaugcauuucaauugugugacacaggcagacuguggaucaaaagug

SEQ ID NO: 2248572 - RNA, 92 nt, Homo sapiens
guagagguugaggugauuugucugcaggaauaguggaacuagacagggaaaugauuuauuacucuaaugacaaaugaucaacaaacuucugc

SEQ ID NO: 2248573 - RNA, 55 nt, Homo sapiens
auaccugguagucuugcuacacucuucaaagagggauuaagaccaugcuagguau

SEQ ID NO: 2248574 - RNA, 105 nt, Homo sapiens
uugagacagggucuugcucugucaccuaggcuggagugcaguggugcaaucucggcucacugugcaaccuccaccucccagguucaagcaauucuccugccucag

SEQ ID NO: 2248575 - RNA, 57 nt, Homo sapiens
uuaggaucacagaaaauccucuacugaagaacacauagguaggaucugugaaucuga

SEQ ID NO: 2248576 - RNA, 72 nt, Homo sapiens
gaagagaccauucuauguagagggaacagccugagcaagagggcuggaggccugaacauaaaugguguuuuc

SEQ ID NO: 2248577 - RNA, 72 nt, Homo sapiens
cuucauucacacugagacauguuugcuuaucugagacaagaguccacaugaggaaaugucuguuuucugagg

SEQ ID NO: 2248578 - RNA, 61 nt, Homo sapiens
gcugugucauccuugcucgcaccugcacccaucaccuggugagcggcacuggagacacagc

SEQ ID NO: 2248579 - RNA, 58 nt, Homo sapiens
guggcgagaucauagcucauuguagucuccaacuccugggcucaagugaucuuuccac

SEQ ID NO: 2248580 - RNA, 63 nt, Homo sapiens
cugggcccaucuugagcacacaguuagcacccuaggaucuaacuaugucucaggauguccuag

SEQ ID NO: 2248581 - RNA, 57 nt, Homo sapiens
cuacgguuuguauaacuccucauguuccauuacaugugcagauguuacaaauuguag

SEQ ID NO: 2248582 - RNA, 101 nt, Homo sapiens
auguaguugagcgguuuugagugaguuucuuaaucccgaguuguaguuugauugcacuguggucugagagacaguuuguuauaauuucuguucuuuuacau

SEQ ID NO: 2248583 - RNA, 88 nt, Homo sapiens
uggaauauuucuaaaugggaccuggaaauuggaauuagaaguuuggaguuacuucuaaagccagugauuaugucucuuuagagaucca

SEQ ID NO: 2248584 - RNA, 78 nt, Homo sapiens
aaggaggaucccagcuccagccccuggugcccugggguggguucugcaggacaccugguguggaacuggagucuccuu

SEQ ID NO: 2248585 - RNA, 95 nt, Homo sapiens
ucaaggauacuugaguagaacugguuaucuaauauuauacauuuuauauauuggguaaagauccaguuuucauucaagcacauauauuuccuuga

SEQ ID NO: 2248586 - RNA, 68 nt, Homo sapiens
gaggaaucauauggauuuuaggauacaguugaaaguuuacuuuaaauuuccuggguuccaugcuccuu

SEQ ID NO: 2248587 - RNA, 90 nt, Homo sapiens
agagugagaaggacuucaucuugugcuuugagugcaagcuuagcugcaguaguauagagcacaagguagauuucuaagguuucugacucu

SEQ ID NO: 2248588 - RNA, 62 nt, Homo sapiens
cugaagcugaaggaaagaauauguacauuaaaauguacaccauuugauucuuuaagcuacag

SEQ ID NO: 2248589 - RNA, 79 nt, Homo sapiens
gguccuaauggaggacaaugucaccuucagauggugugugcaucucuggaggacguguccaccaugaaagauuuggacu

SEQ ID NO: 2248590 - RNA, 76 nt, Homo sapiens
cuugagcuugagauccuuucugaagaaguuuuaacgcauagggaaaggcuacaaggacaaggaauucgaggucagg

SEQ ID NO: 2248591 - RNA, 78 nt, Homo sapiens
uacaugcauccaugugaagagaccaccaaacaggcuuugugugagcaaugaggcuguuuauucacuugggugcaagug

SEQ ID NO: 2248592 - RNA, 121 nt, Homo sapiens
gacuaugacaguuuucagacugcuuacuguuuaugacauugacaguuuuuaggaauacuggccaagaauuuuuuuauaaugcucaucacuugaaguuuguuugauauuuucucucaugguu

SEQ ID NO: 2248593 - RNA, 61 nt, Homo sapiens
uugcuccccaggaaaggaagcaugaccuugggugagacaguucucuuuggcugggaagcaa

SEQ ID NO: 2248594 - RNA, 72 nt, Homo sapiens
augaauuuuggagggggcauucaaaacauuuuaucacucccaaaagauuucuugugucccuuugcuguucau

SEQ ID NO: 2248595 - RNA, 64 nt, Homo sapiens
uacauaguaagcaucuccugugugccaggcucugcacuagacccuggggaugcuguacuaagua

SEQ ID NO: 2248596 - RNA, 64 nt, Homo sapiens
ccauggagcuugcucugucucucacauaugcauacagaagucaugugagcacagagcaagaugg

SEQ ID NO: 2248597 - RNA, 57 nt, Homo sapiens
ccuguugauguuggcuuugguugugugacuugcauuggccaaugggacgucagcagg

SEQ ID NO: 2248598 - RNA, 97 nt, Homo sapiens
gaggcaggagaaucgcuugaacccgggcagagguuguggugagcaaagauugcgccauugcacuccagccugggcaacaagagugaaacuucgucuc

SEQ ID NO: 2248599 - RNA, 61 nt, Homo sapiens
gggaaauaauauagcuacuuucauuuuacuuugauuaguaugagaguaguguauuauucuc

SEQ ID NO: 2248600 - RNA, 69 nt, Homo sapiens
uauaccacugauuuuauucugacuuguauuauaguuacuuauaauuugaggaugcaaaaugguggugua

SEQ ID NO: 2248601 - RNA, 75 nt, Homo sapiens
guguauggaggugguuuugguuuggcuacaacagagaacugcugacucauucagaguagaaacacuuccauaugc

SEQ ID NO: 2248602 - RNA, 85 nt, Homo sapiens
gauuggucagagcgucagacugugcucuacaauugggugagaccacaggcucugcccuguguuuggguauggucacugacuaguu

SEQ ID NO: 2248603 - RNA, 56 nt, Homo sapiens
cccauaauucaaucuccucccaccggguuccucccauggcaagugggaauuguggg

SEQ ID NO: 2248604 - RNA, 59 nt, Homo sapiens
uagagcaaugacucuggaaaccacuagaagugaggcaggcauccaguaguccugcucua

SEQ ID NO: 2248605 - RNA, 64 nt, Homo sapiens
ugcuacccuuagguuaaaguugagucuuuaaaggaaagcuagacuuuaaggaccuaggguggua

SEQ ID NO: 2248606 - RNA, 57 nt, Homo sapiens
auguagguggucuaguuuguaggguccuuaaaacuaacauugcaugauuaccugcau

SEQ ID NO: 2248607 - RNA, 99 nt, Homo sapiens
guuuggaaaccuuucccguugccauuucagggcaguaaauauagccaauuauacaucagcugucugauuuaaccaucugcaguggcacaugggccaaac

SEQ ID NO: 2248608 - RNA, 64 nt, Homo sapiens
ugcuaugagcaaaaugaggguuaguggaaaucuuggugcacuguaacuaguuugcuuauaugua

SEQ ID NO: 2248609 - RNA, 64 nt, Homo sapiens
acuuggucuagauuuuggaaagccucuauauaucuguuggggucaucagagaaucuacccaggu

SEQ ID NO: 2248610 - RNA, 61 nt, Homo sapiens
acuguaaggcauuucucagacuccagccagaaacugacacaaauggcaagugccauacggu

SEQ ID NO: 2248611 - RNA, 69 nt, Homo sapiens
gucuuuuauuuuacaggcucauaaucagaagggacuugccuuaucucagaugagacuuguaaccuggac

SEQ ID NO: 2248612 - RNA, 78 nt, Homo sapiens
uaccauagguaaugaaugcuaccagcaucuaguggguaguagugagagcccagggaugcugcuuagcauccuacggua

SEQ ID NO: 2248613 - RNA, 61 nt, Homo sapiens
uauucuccagcagcccaguaagccuagggaaaccuggaguugcuuuguugucuggggaaua

SEQ ID NO: 2248614 - RNA, 67 nt, Homo sapiens
cuggugugugacuuuucauuauggggucaaacaaaggauuccucaguaaugucaguagcaucacuag

SEQ ID NO: 2248615 - RNA, 59 nt, Homo sapiens
ggucucggagaggcuaacagauucaguauggauuuuggaauguggacucuuauggggcc

SEQ ID NO: 2248616 - RNA, 75 nt, Homo sapiens
gcuggagggaacacuggcugcucgaguucucccaguaagccuccgagagcuuugaaggcagugcgguccuucagc

SEQ ID NO: 2248617 - RNA, 60 nt, Homo sapiens
ccacacugucuuggugggaaacucagucaaguuauuuccacucucaccuggacagagugg

SEQ ID NO: 2248618 - RNA, 104 nt, Homo sapiens
aauuaaguaaauggauggguaugagccaguuuucucacuguugcagucagaauuuacagauaagcaaagggagaaggcuagaaauauuuaugcaguaauugauu

SEQ ID NO: 2248619 - RNA, 82 nt, Homo sapiens
cugguaggaggugauuggcucauggggguggguuucucauaaaugguuuaacaccaucccuuugaugcuuuccuccuaguag

SEQ ID NO: 2248620 - RNA, 72 nt, Homo sapiens
auguucucaucacuucaagcagauacccucuucuucuuucucacugggaucaaagugaauuaaugagaauau

SEQ ID NO: 2248621 - RNA, 72 nt, Homo sapiens
cugggugugguguccugcaccuauaguccuagcuacucgggaggcuaaggugcaaggaucacuugaguccag

SEQ ID NO: 2248622 - RNA, 85 nt, Homo sapiens
ugacuccggaguauaaaugagagaauuucugauagguuuguaaugcauaauuacauugucauauucucucucuuuuugguaguca

SEQ ID NO: 2248623 - RNA, 79 nt, Homo sapiens
ccagcucagccuuucaaguagguaggaccacaggcgcaugccaccacgccugggugguuuuuguuuguugguugguugg

SEQ ID NO: 2248624 - RNA, 58 nt, Homo sapiens
gucuguaaucccagaacuucgggaggcuaacaaucacuugaggucaggaguuacagac

SEQ ID NO: 2248625 - RNA, 65 nt, Homo sapiens
ucaaacacuuuccugaguuugugacuuguuuuagcgaauuaucaaacccuaggaggugguuguga

SEQ ID NO: 2248626 - RNA, 73 nt, Homo sapiens
gaagacuaguuucgacacccugagggaggaauugcuuggcuccagaacugagauguguccagaucuaguuuuu

SEQ ID NO: 2248627 - RNA, 63 nt, Homo sapiens
cuauguguccauguguucucaucauuuagcucccaucuguaagugagaacaugugguauuugg

SEQ ID NO: 2248628 - RNA, 61 nt, Homo sapiens
cuccuggcuuggaggaaugugagggcuuugcucaaagccccaagcacuucaggcucagggg

SEQ ID NO: 2248629 - RNA, 95 nt, Homo sapiens
ggguacaugugcaguuuuguuaccuggguagauuguaugaugcuaagguuuaggguaugguugaucccaucacccagguacugagcauaguaccc

SEQ ID NO: 2248630 - RNA, 109 nt, Homo sapiens
gacaggggacgaugcacaggacaggaguguguaggagaaagguaaccacgaucuaaucagucaaucuugccuguaacuguugccauguuuguguguuugugucccuguc

SEQ ID NO: 2248631 - RNA, 64 nt, Homo sapiens
agcuguaguuugguggauguaaauuaaaacaauuuagugauucggaauccaacaagcuauagcu

SEQ ID NO: 2248632 - RNA, 130 nt, Homo sapiens
auucauugaguaugaaucuugaagaacuuaacuagugguauaagaauucuguuugucagggugcauuaauaaaagcauagugccuucuguuaaacgaggauguacuaguuuaguuauucacucaaugaau

SEQ ID NO: 2248633 - RNA, 59 nt, Homo sapiens
cuagguuauguggcuuuucuacuuuggcccagccaacuuggagagugacauaauucugg

SEQ ID NO: 2248634 - RNA, 60 nt, Homo sapiens
agagcaccauuuagcaaggugauauucaaaauaauugaccaccagcugggauggagcucu

SEQ ID NO: 2248635 - RNA, 92 nt, Homo sapiens
aaaugucuggaaaaccuauuugagauuuuccucaaauauuuccuauuugagggaauaacugaagaaaaauucacuagugcugccagagauuu

SEQ ID NO: 2248636 - RNA, 85 nt, Homo sapiens
gucaccauagauuaguuugcauauucuaggauuuuguaugaauggagucauacagucauacaguauguauucuuuuuugucuggc

SEQ ID NO: 2248637 - RNA, 65 nt, Homo sapiens
auauucacuauaugcagaaccaacgugugacagugaccucacuuuggugcuggguuuaguaauau

SEQ ID NO: 2248638 - RNA, 60 nt, Homo sapiens
ucacacuuaucccacucagucauggcaaagagaagacacuacuggcacugguaggugugg

SEQ ID NO: 2248639 - RNA, 71 nt, Homo sapiens
uacaagaaaaggugucgcugcauugguuugaaucuagccaaauccuucauuuuuguagcaccuuucuugug

SEQ ID NO: 2248640 - RNA, 113 nt, Homo sapiens
aggucaggggucgaucuuuaacuaccaggcuuaggucaggcgggcccaggcuugguuucgggucugguuccuuggcuucgggucugguuccuaggcaccaggcuaccugacuu

SEQ ID NO: 2248641 - RNA, 76 nt, Homo sapiens
gcuuugucauggagaugaacuuggguaaagaaaagaagagugcuauucucaaaguccugucacuuccagauaaagu

SEQ ID NO: 2248642 - RNA, 100 nt, Homo sapiens
uugagcagcaccgugccugcuagcccaagugcucuaggauccugagucaucucacgaugacacaggaagucagcacugauggcuggaggcgugcuuucga

SEQ ID NO: 2248643 - RNA, 61 nt, Homo sapiens
cagugacacugaaaaguucgggcagccacuuuuagguagccacuuuuagguagugacacug

SEQ ID NO: 2248644 - RNA, 74 nt, Homo sapiens
uucugacaaguugccaggugaugguauuccaaggaacaaacuuugagagucacugaccugguauaccuccagaa

SEQ ID NO: 2248645 - RNA, 80 nt, Homo sapiens
auugggguguaaaaugccacugcauaagguuuucaugacaauuaaaugaguuaacauauguaaaguggcuggcacauagu

SEQ ID NO: 2248646 - RNA, 78 nt, Homo sapiens
cccuaucacugaccucuugucggagcuccagauauauccuguugucugcuggagaucuugacauugaagucuaugggg

SEQ ID NO: 2248647 - RNA, 86 nt, Homo sapiens
ggaggucucuccgugcacggaaaggcauauuuccuucaccaguguuggcguggaggucucuccgugcacggaaaggcauauucucc

SEQ ID NO: 2248648 - RNA, 70 nt, Homo sapiens
gcuucucucauucaaauuaaagugaauggaagcccauucccuuagacuacuaauaugagcugggagaggu

SEQ ID NO: 2248649 - RNA, 130 nt, Homo sapiens
guuuauaaauuacccagucucagguaguuuuuuauagcagugugagaacagacuaauacagaaaauugguaccaggaguuuggagcacugcuauaaagauacugaaaaucuuuggaacuggguaacaggc

SEQ ID NO: 2248650 - RNA, 65 nt, Homo sapiens
ggauguuuuaagcugcuaaauuugugcugauuuguuaugcagcuuagaaaaugaauacaucaucc

SEQ ID NO: 2248651 - RNA, 81 nt, Homo sapiens
uugugccaagaugagaucagugaagaaguguuuuugguauaaucaaccaaacggcugcuucuuuaugaucuuuugguauga

SEQ ID NO: 2248652 - RNA, 60 nt, Homo sapiens
ucauuucugguccuuaugacacuggccagaccccuccaguacaauguugauuagaaguga

SEQ ID NO: 2248653 - RNA, 83 nt, Homo sapiens
ugauaguuggagcugcagucuaccuggauuuuuauuuaaccaagugaguagauccaagacuguccuauagcuucaaucauuca

SEQ ID NO: 2248654 - RNA, 92 nt, Homo sapiens
auaguauuaaacuaaagugagcuguuuuuacuuucuguuauagauaaaauuucuuuuaggaagugauagguuauuggauuaguuaauacugu

SEQ ID NO: 2248655 - RNA, 94 nt, Homo sapiens
cgaaauauuaagauuggugugaaaguaauugcaguuuuuacgauugaaaguaacgcaaaaacugcaauuacuuuugcacuaaccuaauauauug

SEQ ID NO: 2248656 - RNA, 57 nt, Homo sapiens
gaucuaguauaugaggugaagccaagcagaauagccacaucaccuugaugcuggguc

SEQ ID NO: 2248657 - RNA, 59 nt, Homo sapiens
cugcugccuuuuguucuacuaugcccugccugcagagguggaaucuauagaggcaguag

SEQ ID NO: 2248658 - RNA, 56 nt, Homo sapiens
ccccaagacuaguaauguugugacucuguagagguaucaccuugguagucuugggg

SEQ ID NO: 2248659 - RNA, 56 nt, Homo sapiens
ggagaucacucuuuguagcguguuuuauuuucaaaugucagcagggagugaacucu

SEQ ID NO: 2248660 - RNA, 71 nt, Homo sapiens
auaggcaguguucucacuuguaaacauucacuaaacgaugacuauuguuaccagugguacacaugaccuau

SEQ ID NO: 2248661 - RNA, 61 nt, Homo sapiens
auaccuguagcagacuuaauauuugugacuauaagcauguagguagcucuguuauaggugu

SEQ ID NO: 2248662 - RNA, 56 nt, Homo sapiens
guguguguauauauguguauauguguauauauauauguauauguuuauacacacac

SEQ ID NO: 2248663 - RNA, 74 nt, Homo sapiens
ggguccuugcgugaaugaaaccuagcacagugaggcaacucccuugagggaaacauucacaucauggcgggccu

SEQ ID NO: 2248664 - RNA, 56 nt, Homo sapiens
uugagauguaguuucacuccuguugcccaggcuggagugcaaugcugcgaucuugg

SEQ ID NO: 2248665 - RNA, 129 nt, Homo sapiens
auuuuugacccuuuccagaaugguuucaguacacuauugagguuuguuugcagggaaugagcugcacagauagauuucaguggguaacuaaaaauugaaauagaaagugagaaaguggaacuagaaaau

SEQ ID NO: 2248666 - RNA, 73 nt, Homo sapiens
gaugggaguucaccuugcccacagcagucugcagagcuaaugggggugcugaauguguagggggcaucucauc

SEQ ID NO: 2248667 - RNA, 84 nt, Homo sapiens
cuaaguguccaucaguggaggacuggauaaagaaaaugugguguauacauaucuuuauccaauccuuuagugauggacgcuuag

SEQ ID NO: 2248668 - RNA, 96 nt, Homo sapiens
cauuauuagugccugaauuucccggcuuggcugaauaaccacuguuuauguuuguguuuacagucgacuugggaauaagugucaagacggauaaug

SEQ ID NO: 2248669 - RNA, 89 nt, Homo sapiens
gguauuuuauucucuuuguagcaauugugaaugggaguuuacucgugauuuggcucucuguuugucuguuacugguguauaguaaugcu

SEQ ID NO: 2248670 - RNA, 111 nt, Homo sapiens
ggauauguguguccuguaguaguucagucagauauuuugauaugacuaucuuuuauguuaccaagcacaagagcuguuaauuaaauugggcuacugaaaauacacguguuc

SEQ ID NO: 2248671 - RNA, 72 nt, Homo sapiens
cccaugccuaaucuggugugcucuggacuugcaggaucccuggaguugcagcuaccagacauggugcguggg

SEQ ID NO: 2248672 - RNA, 55 nt, Homo sapiens
agucugugguacuguguuacggcggcccaagccaacuagcacagggucccagacu

SEQ ID NO: 2248673 - RNA, 59 nt, Homo sapiens
gcacagagcaaugagcuacggucugguuuaaguagugacaagaccugauuguucugugu

SEQ ID NO: 2248674 - RNA, 60 nt, Homo sapiens
auuccauuuguuaucacacccguauaaacacccauuuugaugggugggccacaguggagu

SEQ ID NO: 2248675 - RNA, 56 nt, Homo sapiens
uagcuuucaggaaucagguugcagacucagaucaaaagcuccauuccugaaggcug

SEQ ID NO: 2248676 - RNA, 55 nt, Homo sapiens
uguuguaugacacuaccaugguggauaugugucuaaaccuguagaaaguacaaca

SEQ ID NO: 2248677 - RNA, 111 nt, Homo sapiens
uagaagaaaauuaaaccucaauugaaacaugagagaauagugcuguaacauaaacaguaucucuuuuuuguggcaccaguuuuucagugauucaaaggaagaauguuucua

SEQ ID NO: 2248678 - RNA, 79 nt, Homo sapiens
caguagcucugugaccacuagcacagcugccaguggacccccuggucacccugaugcugguggucccugcuagucacug

SEQ ID NO: 2248679 - RNA, 75 nt, Homo sapiens
gcaggaguggaaggcagaagcagucaguacucugugaguuggaaugugugucaugcuuuugcaaaccugcccugc

SEQ ID NO: 2248680 - RNA, 62 nt, Homo sapiens
gugcuggcauuauagucaugagccacugcgcccggcccauaugucuauucuaaugccagcac

SEQ ID NO: 2248681 - RNA, 59 nt, Homo sapiens
ucugugccgagucuccauggugaaaugcucagaaagcucacaauggagacucgggcgga

SEQ ID NO: 2248682 - RNA, 79 nt, Homo sapiens
gucuuuacacacaaaguagauuagucuuccacuugaaacugcccaauggaagaauuucuuuuucugauguuuugaagac

SEQ ID NO: 2248683 - RNA, 68 nt, Homo sapiens
auaguaggaauuugguaaauauuuguugaaugagugaauagauaaauggauaaaugaauaccuacugu

SEQ ID NO: 2248684 - RNA, 76 nt, Homo sapiens
ucgcuugaaccugggaggcugagguugcggugagcagagauugcaccacugcacuucagccugggugacagagcga

SEQ ID NO: 2248685 - RNA, 85 nt, Homo sapiens
uggggaaagcauaaucuuuucaacaaaggguauugggaauacuggguauccacgugaaaaagauugaaauuggaugcuuaucuua

SEQ ID NO: 2248686 - RNA, 65 nt, Homo sapiens
caucuuucuuuuuaaugguauuuuuguagcuuuaucagcugaugaaugcaugaggggaucagaug

SEQ ID NO: 2248687 - RNA, 112 nt, Homo sapiens
gguucguucucuugaaaauugaaagcagaguuuuuaguaauuccuuucugagaugaugaggguuuagauaaggaguaucauauuaaaacuaagcuucaagagaaccaggacc

SEQ ID NO: 2248688 - RNA, 60 nt, Homo sapiens
aucaggagcaguggcugcagaacagcgccuauuggugaauugcaaaugcugcugccugau

SEQ ID NO: 2248689 - RNA, 61 nt, Homo sapiens
aauaccagaagaagcagaaugguucauuguucuggaccucaaggaugccuucuucuguauu

SEQ ID NO: 2248690 - RNA, 87 nt, Homo sapiens
gauguaagacaaaauaaggcaugguuauuaagaaguaaucuaggaauuugauuacuucauucuugaccuugcauauuuagacccauc

SEQ ID NO: 2248691 - RNA, 82 nt, Homo sapiens
cagguuuucaaagaucagaugguaguagaugugugguuuuauuucugaaaccucuguucuguuccauuggucuauauaucug

SEQ ID NO: 2248692 - RNA, 77 nt, Homo sapiens
acauuuuucaauccuucuuugugacuacaucaggucauguaaccaaguuuucaacaauggaauggaguggaaagugu

SEQ ID NO: 2248693 - RNA, 71 nt, Homo sapiens
guagcccuguaguauaguuugaaguuggguagaaagaugucuccagcuuuguuauuuuugcucaggacugc

SEQ ID NO: 2248694 - RNA, 59 nt, Homo sapiens
gagcuuccuggaugaagcccagcauaaaugucuugugcuuauccccauucuggaggcuu

SEQ ID NO: 2248695 - RNA, 71 nt, Homo sapiens
aguuguagcauuugauaguaccauugggaaauuacagcuaacaguaauuuauuggauauuucaaaacagcu

SEQ ID NO: 2248696 - RNA, 74 nt, Homo sapiens
uaguaaguuuuuugugauugagugauccuuguuuuaacaaagacuugauuauuuaguacauuuuugauauauua

SEQ ID NO: 2248697 - RNA, 60 nt, Homo sapiens
ggcaagugucagcagcaacaccccucaccucccauuccaggguguuucucugucacugcu

SEQ ID NO: 2248698 - RNA, 98 nt, Homo sapiens
gaagucauuuuuuuaacuuugugauugcacacucaagaucauggcuaauugaaccagaugggaaagcuugaucacaauuacuuaaauaagaauauuuc

SEQ ID NO: 2248699 - RNA, 83 nt, Homo sapiens
uuuuagacaagaaauuucaauauuauuuucagguccugguauacguggugaugaaaguuauauugugaaauucaauucuggaa

SEQ ID NO: 2248700 - RNA, 58 nt, Homo sapiens
gucucuaccugcacaugccuuauagcaucagcaguagggcuugugaucagguguagau

SEQ ID NO: 2248701 - RNA, 65 nt, Homo sapiens
ucuguauuuuaugaaauacgggugacagaggaacuauccuuugucccccguaguucauauacagg

SEQ ID NO: 2248702 - RNA, 57 nt, Homo sapiens
cagaacugaccucugauucuaggacugaccucugacccuggaacugauucaguucug

SEQ ID NO: 2248703 - RNA, 68 nt, Homo sapiens
uugcuugaggcugggaggcggagguugcagugagccaggaucgcaccauugcacuccagcccaggcaa

SEQ ID NO: 2248704 - RNA, 79 nt, Homo sapiens
aggcuggagugcaguggugugaucucggcucacugaaagcucugccucccggguucgcgccauucuccugccucagccu

SEQ ID NO: 2248705 - RNA, 93 nt, Homo sapiens
uuuuuucaauuuuauuuuagauuugggguacaugcacagguuugcuaccuggcauauugcaugaugcugagauuugggauaugaaugaaagga

SEQ ID NO: 2248706 - RNA, 56 nt, Homo sapiens
agaucuggaagccacuguuucgaaggcaggucagucuuuugaauaguguccaaucu

SEQ ID NO: 2248707 - RNA, 56 nt, Homo sapiens
ugucacggaauguaaguggaaguaauguaugcuaacuuccaaguuguuccuugaua

SEQ ID NO: 2248708 - RNA, 83 nt, Homo sapiens
accgggauuaacacucaggcacucugauuccagugcuguguuuuuaaccauuagaguuaagugccuguauuuguuuccuaggu

SEQ ID NO: 2248709 - RNA, 99 nt, Homo sapiens
gcaggguuacugcugccuagcuccagugggguuacugcugucugacugaggcaccggcguguccccacuugguguccacaggcagcucccagcaccugu

SEQ ID NO: 2248710 - RNA, 61 nt, Homo sapiens
uuggcuaugagucccagcuggcgaauguggcccccacuuuggcaucugggacacaagcuga

SEQ ID NO: 2248711 - RNA, 87 nt, Homo sapiens
ugcagauagacgccuucuugcuguauccucacauggucgagagaugaucuguuuuccaugugaggauaucacaaguucucucuugca

SEQ ID NO: 2248712 - RNA, 63 nt, Homo sapiens
cuagcagggguaccugugaccucaagagccucagaggacauauguuacagugugcccuuuuag

SEQ ID NO: 2248713 - RNA, 97 nt, Homo sapiens
augugaggacaugagaucugggagggacugaggugaaaugauaugguuaggcuuugugucccuacccaaaucucauguggaauuguaauccccacau

SEQ ID NO: 2248714 - RNA, 57 nt, Homo sapiens
gaaaagccucuccucuccagguagacacagccccauuuggggaauggagagguuuuc

SEQ ID NO: 2248715 - RNA, 129 nt, Homo sapiens
uguccugugagccucuaaagcagugguuuucauuccggagugauuuuaacuuccagcaauguccgaagacauuuuuagucgucaaagcauuccgggaagaggagcaugcuacugacaucuaguggguag

SEQ ID NO: 2248716 - RNA, 59 nt, Homo sapiens
ucccaccagaucccauggcaaacacugcagauuacaauuugacaugagauuuggugggg

SEQ ID NO: 2248717 - RNA, 78 nt, Homo sapiens
guaaacucuuaggaaaugugaacugaauuaauucacaggcaaaaccuuugaguuugugucacauuucuuuuagauugc

SEQ ID NO: 2248718 - RNA, 86 nt, Homo sapiens
gcuccuggcugaccccugagaucgaaucaugcuguuugcuaauguguggaaaguauguuuugcucucuaggaguccuccccagagc

SEQ ID NO: 2248719 - RNA, 76 nt, Homo sapiens
uaggcaggccuaaggaauccugcagaugauuuuggauccauagggauuuugcaguuuauuccuggggcucugcuug

SEQ ID NO: 2248720 - RNA, 61 nt, Homo sapiens
ggggagaugcugucugcagcugggcagcgccagaaggccugugacagcacagcaucucuuu

SEQ ID NO: 2248721 - RNA, 61 nt, Homo sapiens
acuuccaucaacaccagaucacaucaucuuccacucuguugaugugucugguuaugggagu

SEQ ID NO: 2248722 - RNA, 99 nt, Homo sapiens
acaaacgguuccuggccuuguaaauaccaguuucuggaacagaguuucugaauuucugucuuagaaauuauguauuuaauaaaugugagaauaauuugu

SEQ ID NO: 2248723 - RNA, 106 nt, Homo sapiens
ggaaaaaaaaaauguguuaauacaucuauaaacugcuugaaauggugucaggcagauacgucuuauaucaguauuguuguuguuuuagauguguggacugaguucc

SEQ ID NO: 2248724 - RNA, 82 nt, Homo sapiens
agaggaggggaauagugcugugcagugagugguacuggggguugcccuggcccacuggguagcacuguguuucucuuucuuu

SEQ ID NO: 2248725 - RNA, 57 nt, Homo sapiens
ugcagugugaaagagccugacagguauuuggcuuuccagcuuguucuuucaacugua

SEQ ID NO: 2248726 - RNA, 59 nt, Homo sapiens
ggcuuuggucacacaggggcaagcuggugcuucauuccagaccucucugaccccaagcc

SEQ ID NO: 2248727 - RNA, 84 nt, Homo sapiens
cuucgcagucagguauuucugaggaagagacauaugaaacgcaugugguuuuucacauuuagagaaagugacgacuguaagaag

SEQ ID NO: 2248728 - RNA, 66 nt, Homo sapiens
ugucguugguucuguuuauaugcuggauuacguuuauugauuugcauauguugaaccagccuugca

SEQ ID NO: 2248729 - RNA, 59 nt, Homo sapiens
uaucacuauucauccuagcuccaugugcucuuuagggcaggagaguaugaagagugaug

SEQ ID NO: 2248730 - RNA, 76 nt, Homo sapiens
gggggccauaggcaggugaaagauaguuuuauucagcggcagcucucauuaacagcuuucuuacacuagcucucuu

SEQ ID NO: 2248731 - RNA, 55 nt, Homo sapiens
gggagggaagaaggcuuauaggucagauggggcugccaugauacugcucccucuc

SEQ ID NO: 2248732 - RNA, 68 nt, Homo sapiens
gauaaaugcuugaguggaugguaucccauucuccauaaugugauuauuaugcacugcaugccuguauc

SEQ ID NO: 2248733 - RNA, 63 nt, Homo sapiens
cuugggguuuuucuuuacagcaauucaaccaaugaggggaugaaugugaagaaaugcugcaag

SEQ ID NO: 2248734 - RNA, 108 nt, Homo sapiens
cagaucagaagcagcauucgauugucauaggagugugaacccuaugaacugcacaugcaagggaucuagguugcacacuccuuaugagagucuaugccugaugaucug

SEQ ID NO: 2248735 - RNA, 85 nt, Homo sapiens
gcuauauaugaugcugcaaauuuauuuucauaauugcuauaacuggcagggcaagcagaugauauguuuguagcuaucucguggu

SEQ ID NO: 2248736 - RNA, 69 nt, Homo sapiens
uaaaguggggaaaguugugacuuuaaaccucacauguauuacaccuuaaucauagcuuuuuccacuuua

SEQ ID NO: 2248737 - RNA, 70 nt, Homo sapiens
cuugagucucggagguugaggcugcaguaagcugauaucacgcuacugcacuccaaccugagagagcaag

SEQ ID NO: 2248738 - RNA, 93 nt, Homo sapiens
ggcccuaggagcuacccgccauguuuuuaaaagccuuagggaaaucauauuuugcuuaggcuaacaaaaauagcaguggcuuugcuugggguu

SEQ ID NO: 2248739 - RNA, 88 nt, Homo sapiens
ccuggauacccuaugugcuagguacuguuuagcagugaacaaaacagacaaaaaucccugcacucauagagcuuacauuauauucagg

SEQ ID NO: 2248740 - RNA, 81 nt, Homo sapiens
gcccugaggagcaccagucccugucagugccaccaauucuuguaugucuuccggaggccugacugagagacgggugugggc

SEQ ID NO: 2248741 - RNA, 67 nt, Homo sapiens
gggucccauuguaaacggccaacuacccauccccagggcccuuggugccguccugcaauccuggccc

SEQ ID NO: 2248742 - RNA, 113 nt, Homo sapiens
gugaaugaaggcaaauagggauguugcauuugucaaggucaagcaaagacagaaacaguuuuaucuugauguacuuaauaagugccaauaucuuaauuuccuaacucauuuau

SEQ ID NO: 2248743 - RNA, 81 nt, Homo sapiens
uaggaaguccuuuccccauugcuuauuuucaucagucuuauugaagauuagaugguuauaggugugaggcuuuauuucuua

SEQ ID NO: 2248744 - RNA, 117 nt, Homo sapiens
ccugccccuguucucccccaugccccuagagcuacagcccucacugucccgugaggggaaaaggcauggugacaaugggggcuguagcccuaggagaacggggggaagaugggcagg

SEQ ID NO: 2248745 - RNA, 78 nt, Homo sapiens
aaaaaaaauuuagauauauauauaaugggggaaucauaaacguguggaagucuucauuauguauaguaaguuauuuuu

SEQ ID NO: 2248746 - RNA, 66 nt, Homo sapiens
aagucuuaaggcuguaggcaggguuugguaacuuguaucaggcacucagcuuagagucuggggcuu

SEQ ID NO: 2248747 - RNA, 64 nt, Homo sapiens
acuucucuaggccacagacaucugcacuguauucuagugcugugauauuuuuggccagucaggu

SEQ ID NO: 2248748 - RNA, 75 nt, Homo sapiens
uacuguuuuguaucuggcuucuuuuaguccacauacuauaugugagauuaacuggugcuauuacauguaacagua

SEQ ID NO: 2248749 - RNA, 78 nt, Homo sapiens
uugugauuauuaagugcuugcagaaguccaugaccucgguguuauaggcuucuaaagugcaaguacuauacuucauaa

SEQ ID NO: 2248750 - RNA, 59 nt, Homo sapiens
uguauauucgcacagauguagagaaauuaaaauccuccuacacuacugguggaaaugca

SEQ ID NO: 2248751 - RNA, 89 nt, Homo sapiens
caguuucuuugcuggagauguuguagcuuucacuguuaacuugguaagcauucuccuaacaguguauuuacuacuuccuaaaggaauug

SEQ ID NO: 2248752 - RNA, 122 nt, Homo sapiens
aagagccagcugaugucauuccugcagguuacagugaauguuggaaaguuauuucaacuagaccaaaguuucagaaaaaaauuuccaagauuuagagcuuuaggaacauuagauggacuuuu

SEQ ID NO: 2248753 - RNA, 61 nt, Homo sapiens
ucugcaagagugguucugugaggaaagccugguuccagugccuugaaggccgccuugcaga

SEQ ID NO: 2248754 - RNA, 73 nt, Homo sapiens
uuuuuauagcuauuguuaauggaacugccuucuugauuuccuucucaagcaguucauuaaugguguauagaaa

SEQ ID NO: 2248755 - RNA, 82 nt, Homo sapiens
aguuuuaggguacaugugcacagugugcagguuaguuacauauguauacaugugccaugcuggugcgcugcacccacuaacu

SEQ ID NO: 2248756 - RNA, 85 nt, Homo sapiens
ggccaguaaguaugaucaaccuauaacaaaauagaaauaaacuaaauauuaucauuucuugguguaguaguugaaaacauuggcu

SEQ ID NO: 2248757 - RNA, 91 nt, Homo sapiens
ugguugaauuuucucuguagagcaauuaccaguaugagucaaaggccaugauuuauguaggcuauagcucugcaauuuagauuguuuacua

SEQ ID NO: 2248758 - RNA, 99 nt, Homo sapiens
ugagauggagucucgcuguugccuaggcuggagugcaguggcgcucucuuggcucauugcaaccucugccucccggguuccagugacuuuccugccuca

SEQ ID NO: 2248759 - RNA, 82 nt, Homo sapiens
aguagaagaugaauacaaagcuuucugcaaaucauuuucaaaggaaagugaugacccuguggcuuguauucacuuuacugcu

SEQ ID NO: 2248760 - RNA, 72 nt, Homo sapiens
cuguugcuuuggcaaugucauuuucaaucauacaggaguauguguuguugaucguaacauuguagagcacag

SEQ ID NO: 2248761 - RNA, 76 nt, Homo sapiens
cagugccagggauuucaugggcagucgucauuaaaugugcauggcaagccugacaugagacuguucuuccucauug

SEQ ID NO: 2248762 - RNA, 90 nt, Homo sapiens
ugcccagcagcaccuuggggugaaugcauuaagaagggggaacugucaucucauucucccucucagauuuauucacagucuccugcggca

SEQ ID NO: 2248763 - RNA, 70 nt, Homo sapiens
aagacaucacuggucauggggcagcugacacuuccauagagaagugagcaucucuuggccacuuugucuu

SEQ ID NO: 2248764 - RNA, 82 nt, Homo sapiens
ugaacuuuauguaaauggacuuacacaguauguuuucuuuuauguguggcuucuuugguucaguauuauuuugugaaguuca

SEQ ID NO: 2248765 - RNA, 61 nt, Homo sapiens
cauugcuuuuggugguuuagacaugaaguccuugcccaugucuauguccugaaugguaaug

SEQ ID NO: 2248766 - RNA, 59 nt, Homo sapiens
ugagucaauucuaacaauggcaaucaaaugccaugccacuugauuacugaauugacuug

SEQ ID NO: 2248767 - RNA, 63 nt, Homo sapiens
gggcuucaugaaugccagcuugauaaacacguaccuguagcuaucacuggguucuugaagucu

SEQ ID NO: 2248768 - RNA, 65 nt, Homo sapiens
gugaguuguuuucacaaacccaugauggauaauggcuaauggguaguacugugguaacaaagcac

SEQ ID NO: 2248769 - RNA, 83 nt, Homo sapiens
aaugugaggcuacauuguuacaauuaguauauauuuccagagaauugugacuuucaguauuauguaacaauaguccuuauguu

SEQ ID NO: 2248770 - RNA, 79 nt, Homo sapiens
aauugaaggugauuaggcagaagaaauuuuaucguauuuugggaagaaucagucuuuuguucuauucaggccuucaguu

SEQ ID NO: 2248771 - RNA, 84 nt, Homo sapiens
guggguguguuugugggggucuguauguguaugcaugucuacauaaacagacauauaugcauacccucaccaacuacacacuac

SEQ ID NO: 2248772 - RNA, 58 nt, Homo sapiens
gcaguagguacuucugguuucuggucugacaaguaaggagcuuagaaguugccauugc

SEQ ID NO: 2248773 - RNA, 67 nt, Homo sapiens
uuagaacaguguuugccucgcucucacucacucucauaaaugcuagugauggucaugcacugucuga

SEQ ID NO: 2248774 - RNA, 62 nt, Homo sapiens
gacuuagaugucuuccugacuguauuuuagagugcuaaacuucagucauagacaucagaguc

SEQ ID NO: 2248775 - RNA, 55 nt, Homo sapiens
gugguagacaugaugggcacugcagucugacucuagagcucaucuucuuuaccac

SEQ ID NO: 2248776 - RNA, 65 nt, Homo sapiens
guaggugcaugguagacucucgggucaugggagauuauccucauggcagagucaccugucccugc

SEQ ID NO: 2248777 - RNA, 65 nt, Homo sapiens
gaauuuguuuaguuaguagacucugauuauucuuggaauguuagaucuuauuaacagauaaguuc

SEQ ID NO: 2248778 - RNA, 79 nt, Homo sapiens
uaucacuggaaguuaaaugacucuuucugaaaagcagccagacgcuucagauggagggauguuuggcuccugagugaua

SEQ ID NO: 2248779 - RNA, 91 nt, Homo sapiens
ucuauguucaugguaaccuugaccaauggcuucacuuuuuuggugauaauuuugucagguuuuggaaucaagguguugcuagcuguauaga

SEQ ID NO: 2248780 - RNA, 58 nt, Homo sapiens
agaaguacaaaguaauuuuuauuuaugccccuguauagguagaguguuuuguucuucu

SEQ ID NO: 2248781 - RNA, 70 nt, Homo sapiens
gacuacuguaaaccuagcauuuugcauauguauuuuugugcauguuggugcagguuuauaaucauuaguu

SEQ ID NO: 2248782 - RNA, 86 nt, Homo sapiens
gucacuacauuuuauuuugaugcuagauggauguguaggaauaucuuaucauugccucaaucuguauuuuucugaaauguagugau

SEQ ID NO: 2248783 - RNA, 58 nt, Homo sapiens
cugauugugcagagguguaauugaaauguuuuguucaauguuacacagguauaaucag

SEQ ID NO: 2248784 - RNA, 67 nt, Homo sapiens
gggguauuugagguaucuaucacucaaacauuuaucauuucgauguguuagguacauucaagucucc

SEQ ID NO: 2248785 - RNA, 112 nt, Homo sapiens
cugucagaugagugagacuuuuggaacuucaagacuaaaucuguggccuggaauccagauucagguaaucuauuugucuuuuuacauuuuaaaaauguauccuuuaugacag

SEQ ID NO: 2248786 - RNA, 67 nt, Homo sapiens
ccuuggucucaucaagagcagcuuuguaguucucugagcuguggggucucuaggcugagaacugagg

SEQ ID NO: 2248787 - RNA, 71 nt, Homo sapiens
guggauugcuuaagucccuguauuaguccguucucaugcugcuaauacauauuggagacuggguaauuuau

SEQ ID NO: 2248788 - RNA, 85 nt, Homo sapiens
cuuucauaagagauaaagaggcaagugggagacagcauuuggagcaauucuucacaugccucccauuguccugcauuuuagaggg

SEQ ID NO: 2248789 - RNA, 89 nt, Homo sapiens
gccuuugguuuggaauccuuguagccacaaguggugaggaaguuuaaaagcgcuuugguggcuugauggcacaagguuucugaaugggc

SEQ ID NO: 2248790 - RNA, 91 nt, Homo sapiens
uggcugggucaaaugguauuucuaguucuagauccuugaggaaucaccagacugucuuccacaaugguugaacuaguuuauggucccacca

SEQ ID NO: 2248791 - RNA, 64 nt, Homo sapiens
gggaaagaaagagaacauucguguucucaaagccaaagagaaucacuguuaacaauuucuuccu

SEQ ID NO: 2248792 - RNA, 66 nt, Homo sapiens
ugugcugagaaaugcaucauuaggugauuuuguuguugcaaaacauccuagggugcacuuaacaca

SEQ ID NO: 2248793 - RNA, 75 nt, Homo sapiens
ucacuugagccuaggcgguugaggcuguggugagcugugaucacgcugcugcaaccagccugggcaacagaguga

SEQ ID NO: 2248794 - RNA, 94 nt, Homo sapiens
cacaagcaauaggaacaugcucuugauuugaguucucugaauucaaaaauucaaaggauagauuaagaucagcagaaguuuagaggagcuggug

SEQ ID NO: 2248795 - RNA, 84 nt, Homo sapiens
ccugggagcuuguugaaaugcagaacuuuaggucucaucgcagagcuauugaaucagaaucugcauuuuaaugagauucccagg

SEQ ID NO: 2248796 - RNA, 74 nt, Homo sapiens
guugcagugagcagagaucgcgugauugcacuccagucucagugacaagagugaaacucugucucaaaaacaac

SEQ ID NO: 2248797 - RNA, 84 nt, Homo sapiens
ugugauuucccggagcaucucauucccauuacuucaaaaauagcacagaacuguucugauggcacagugaguuccagggauaca

SEQ ID NO: 2248798 - RNA, 68 nt, Homo sapiens
ggguacaugugcacacugugcagguuaguuacauacguauacaugugccaugcuggugugcugcaccc

SEQ ID NO: 2248799 - RNA, 75 nt, Homo sapiens
auaaccgaauucugucacuuaggaggucauaaaaucagacacagacaugugacacugaauggcagaacuaguuau

SEQ ID NO: 2248800 - RNA, 60 nt, Homo sapiens
ucugcucuuagcuuugcccaagauugucugaaugaucuugggcaaaucacugagggcaga

SEQ ID NO: 2248801 - RNA, 127 nt, Homo sapiens
gaaaugaaacuuagcagauuguagcauauuaucuuuuugauauguaguuggacuugauuuucuugugucuuguugaggauuuuuccaucuauagucaucagugauauugaucuguaguauucauuuu

SEQ ID NO: 2248802 - RNA, 99 nt, Homo sapiens
auucagcuuauaaugcauuacuaucacuguuuugaugcccggaucgucucagagcguccgagcaucaaaacagugauaauaauggauuauaagcugaau

SEQ ID NO: 2248803 - RNA, 55 nt, Homo sapiens
uugcaaaguugccaaggaaggagcuaggccggagccugaaaggcaaacuuuguaa

SEQ ID NO: 2248804 - RNA, 74 nt, Homo sapiens
acagaagaaguucaaggugaagucuggggcuauacauuucaaggucauuuauguuucacugugaguuuuucugu

SEQ ID NO: 2248805 - RNA, 59 nt, Homo sapiens
aaguuccuuguagaugcuggauauuagaccccugucagaugugcaguuugcaaaaacuu

SEQ ID NO: 2248806 - RNA, 58 nt, Homo sapiens
gggguuccugugauuguuagaaagugacauucuuuacuuaucacaguucaggaacucu

SEQ ID NO: 2248807 - RNA, 115 nt, Homo sapiens
guuuaagaauucagugcuuccuuuuaaagagucacauugguuugcaauuaaguauuaggaaaugaaguucuaauacugcuuugauguaagcuagugugcuuggcaauuucuaaau

SEQ ID NO: 2248808 - RNA, 75 nt, Homo sapiens
acacaggacacaaaagucaccauuuaaacuauuuuaaaguguccaauuugguggcuuuucguagguucacagugu

SEQ ID NO: 2248809 - RNA, 56 nt, Homo sapiens
aaggauaacugaguuugcugcuacccucucucguagcaccaauaaucagaguucuu

SEQ ID NO: 2248810 - RNA, 80 nt, Homo sapiens
cuggagauauuggaagaaagaaauaaacuaggguagcucauaucacccauuccauguuuuuugucuuuaggaugucccag

SEQ ID NO: 2248811 - RNA, 76 nt, Homo sapiens
cucaucacaaauaucaagguacauacuaucaacgugacuuaccacugcugauguugaccuugaucaccugggugag

SEQ ID NO: 2248812 - RNA, 130 nt, Homo sapiens
uucucuugucugauugcuccagcuaggacuuucaguacuauguuguauaggcauggggagaauggauguauuagucaauucugaugcugcuuauaaagacauacuugagacuggguaauuuauaaaggaa

SEQ ID NO: 2248813 - RNA, 65 nt, Homo sapiens
uauuucaguugugcagguaguuugcauuuuaaaucaucucacacaacuugcuggaaacugaaaug

SEQ ID NO: 2248814 - RNA, 56 nt, Homo sapiens
uuaucuuaggucuggaagcugcucuugagagcaaugugcuuguccacgugagauaa

SEQ ID NO: 2248815 - RNA, 69 nt, Homo sapiens
ugcaguuggauuuugguauauacggggguccuguaaccaauccccugccuauaccaggcguugacugua

SEQ ID NO: 2248816 - RNA, 71 nt, Homo sapiens
gccaguauuuuauugaggauuuuugcaucaauguucaucaaggauauuggccuaaaauucucuuuuuuggu

SEQ ID NO: 2248817 - RNA, 128 nt, Homo sapiens
ucuccgcaaccccugcauuuugcugggagguauuagguuggggcaaaaguaauggcagaaacagaaauuacuuucgccccaaccuaauaguuuucccccgucucaauuugccacaaagggugagaaga

SEQ ID NO: 2248818 - RNA, 71 nt, Homo sapiens
uuugaacccaggaggcugagguugcagugagcugagaucgcaccauugcacucuccagccucggcaacaga

SEQ ID NO: 2248819 - RNA, 72 nt, Homo sapiens
gaagcaauuaguuaagcaacuauaaaauggaagauuauuccauuguuaugggguggcuugaaagaaggcuuu

SEQ ID NO: 2248820 - RNA, 61 nt, Homo sapiens
gaaaauccauccccagggaguagaguaauacaguaauaucuuacuuuggggaucuauuuuc

SEQ ID NO: 2248821 - RNA, 68 nt, Homo sapiens
gggcauucacugugcuuggccaaauuguuuaauucuuaaaacaauauucuggccaggcaugguggcuc

SEQ ID NO: 2248822 - RNA, 65 nt, Homo sapiens
cucacaauucagacaugugugcauuagauuaacuaguaugaugacauugucacagucugagugag

SEQ ID NO: 2248823 - RNA, 76 nt, Homo sapiens
gucacguuacuguaaggcaggagcauucuggagcuugcgugcaacuuucccauugucucugaccuugccaugugac

SEQ ID NO: 2248824 - RNA, 62 nt, Homo sapiens
caugggcacugacuugcauucgccuguucaaagacaaacaugagugcugcuucgugcgugug

SEQ ID NO: 2248825 - RNA, 59 nt, Homo sapiens
uucacugugaauaaaggcucccaaugaauucucaugaguuuuuaauggucauagcugag

SEQ ID NO: 2248826 - RNA, 66 nt, Homo sapiens
uuauguaaaucaaucuggaaucaugacugagaaaguuaaagaaauuugagauugauuacaacauag

SEQ ID NO: 2248827 - RNA, 60 nt, Homo sapiens
ugaaggaguauggauaagucguauccuucucuuugcuuuugacuaugcuuugcucuuuca

SEQ ID NO: 2248828 - RNA, 60 nt, Homo sapiens
gucucacugucaacauguauuuggggagacaucaaacucaguaugaauugacaggaugau

SEQ ID NO: 2248829 - RNA, 69 nt, Homo sapiens
gugcuauaagguuaggaaaaauuucucugaggaauuaacauuuaagcugagauccauagcuuuaagcau

SEQ ID NO: 2248830 - RNA, 55 nt, Homo sapiens
ccuaggcaauguacauaucggcccauguuacagauggggaaauggacuugccagg

SEQ ID NO: 2248831 - RNA, 91 nt, Homo sapiens
ugccuaggauaacacagcucauuaguggaagcaucaggacauggcuuuucaguucaaugcucuuucuacuauaaagugcugcauccaggca

SEQ ID NO: 2248832 - RNA, 76 nt, Homo sapiens
uugcuugaauccgggaggcagagguugcagugagcugagauugcgccacugcacucuagccuuggcaacagagcaa

SEQ ID NO: 2248833 - RNA, 58 nt, Homo sapiens
aacuucugccuggagauccaggcauuuccauacauccucugagaucuaggcagagguu

SEQ ID NO: 2248834 - RNA, 62 nt, Homo sapiens
gagcauccugcagcugcugcuugacgugcucgaugggcgcguaggccgggugcaggaugcuu

SEQ ID NO: 2248835 - RNA, 62 nt, Homo sapiens
ccuaucuccaugaguaaacuaagaagcauucaaaucaacuuuuuguguuucauggaaauagg

SEQ ID NO: 2248836 - RNA, 74 nt, Homo sapiens
ggcuagaugaagggacugagcauauccuauccaguacauguaugagagugagagcagccccuuaaaaaucaguc

SEQ ID NO: 2248837 - RNA, 80 nt, Homo sapiens
uguggcugucugacuaggggcccuggcuucuuacuggcucugaacuggaaguggccaucagguccuagcagccacccaca

SEQ ID NO: 2248838 - RNA, 68 nt, Homo sapiens
gugccaucuuaggugaugauugaugugaaguaauauaucugucaauuauucacauaggccuggggcau

SEQ ID NO: 2248839 - RNA, 64 nt, Homo sapiens
augauugcguauguaaaugcuuauaauaguacccggcaaacaauaagcaagcauuugcaaucau

SEQ ID NO: 2248840 - RNA, 64 nt, Homo sapiens
auugugaauagugccacaauaaacauaugugugcaugugccuuaauugcagcaugauuuauaau

SEQ ID NO: 2248841 - RNA, 58 nt, Homo sapiens
ugagacggagucuggcacugucacccagacuggagugcaauggcgcgaucuccgcuca

SEQ ID NO: 2248842 - RNA, 57 nt, Homo sapiens
uucagugguuauuugugagauuuggguguacccaucaccgaagcaguaaucacugaa

SEQ ID NO: 2248843 - RNA, 80 nt, Homo sapiens
ggcuggggggcagugauguggaguuuggauggaggggcuuaccugauccgagccuagagcccacaccugcacuccaugcu

SEQ ID NO: 2248844 - RNA, 109 nt, Homo sapiens
guaacaaauggccuaugugaacugaacugagcuggugaauaucaguuaagaaaaggcagucacuguguguuugucuagcacaggcagcauguaggacccuguagguuau

SEQ ID NO: 2248845 - RNA, 55 nt, Homo sapiens
uugggcaauaggaagcagguggucaguuaggcaaucauggcaucuuauuguccag

SEQ ID NO: 2248846 - RNA, 101 nt, Homo sapiens
gcagcgugaaaauguacgaauacaguuugcuagaauuuuguugagaauauuugcauguauguucaucagggauauuggcuuauuguuaucuuuucuguugu

SEQ ID NO: 2248847 - RNA, 57 nt, Homo sapiens
augucauagaagccugugaacccagcuuuaguuaugcacuggaauuuucugugacau

SEQ ID NO: 2248848 - RNA, 55 nt, Homo sapiens
caaggauuguaacaccaagguuaguccuagggcugaacugggugcauagaccuug

SEQ ID NO: 2248849 - RNA, 69 nt, Homo sapiens
cuugaacuugggaggugaagguugcagugagccaagaucaggccauugcacuccauccuaggugacaag

SEQ ID NO: 2248850 - RNA, 127 nt, Homo sapiens
ucaugcuuugggguuccuuuuucuaagaaccacacuuugugucuggcuccugucuaaucacuguggcauccugacauagugauuagaaaggagccagacgcaaagaagggaacauuagacaccaugg

SEQ ID NO: 2248851 - RNA, 111 nt, Homo sapiens
aagugagagagaagcuggauaaaguagaggugaggugcauggacacuggguacuuccaugcguuucauuccuacuuuuauuuccagccuuugcuauugaaucuguucacuu

SEQ ID NO: 2248852 - RNA, 92 nt, Homo sapiens
ugggccugagcuaaagcuuuuuugauuaauggguagaccacaauaacauuuuggaucuccugggauuaaugucagcucagagccagugccca

SEQ ID NO: 2248853 - RNA, 67 nt, Homo sapiens
gaaaaagacacuaucaacaaagagcaguggacuaaaauucagcaucaaugucuauaguguuuguuuc

SEQ ID NO: 2248854 - RNA, 78 nt, Homo sapiens
cggacaagucaguagucaguucaggucaaagaaaaggugccacuauucuugcacuuaacugacauucugaaauuucug

SEQ ID NO: 2248855 - RNA, 77 nt, Homo sapiens
ucgcuugaaccugcgaggcggagguugcagugagccgagauugcgccauugcaauccagccugggcaacaagaguga

SEQ ID NO: 2248856 - RNA, 76 nt, Homo sapiens
cucucuggcagaguuaguagccuuugacaauccugagcccuagaaauauugugaaggccuuaacauuuccagaggg

SEQ ID NO: 2248857 - RNA, 87 nt, Homo sapiens
guaguguaggcauucagguuucuauuacuccaauauaguagucgcuuauuugaacugguaguuggaaaucugaauuugucugacuac

SEQ ID NO: 2248858 - RNA, 68 nt, Homo sapiens
ggauacauucuaagaaacgugucacuaggugguuccaucauugugcaagcaucauggaguguacgucc

SEQ ID NO: 2248859 - RNA, 75 nt, Homo sapiens
uagaguuaaaccuggguuggagcccugcuucagucauuuacuagcaguguggccuuagacccggccucagcuuug

SEQ ID NO: 2248860 - RNA, 128 nt, Homo sapiens
cacuucagcccaggaaucugagaccagcuuaggcaauguggcgaaacucuguuucuacagaaaauacaaaaaguagcggggugugguggcacgugccuguagucccagccacuugggaggcugaggug

SEQ ID NO: 2248861 - RNA, 121 nt, Homo sapiens
gcagccacauucacaguuucauuuuugccuuuuuugaaguccuauagaagcagagaaaagagagcaaugggguuuuuauggcucuuggggaaguagagagugaaucaaaaauguuugcugc

SEQ ID NO: 2248862 - RNA, 79 nt, Homo sapiens
gccauaguuuacugagaaugaugauuuccaguuucauccaugucccuacaaaggacaugaacucaucauuuuuuauggc

SEQ ID NO: 2248863 - RNA, 79 nt, Homo sapiens
uuuucaguaguaaauggauuuggaagucugagauauuuucaaauacauucuuggguuuuuaaaauuuauuaccagaaaa

SEQ ID NO: 2248864 - RNA, 85 nt, Homo sapiens
guaacucaaugaaagaagcugguuaaaggaugugauuaucaaguuugagugacuaguuuugcuguuguuauuucauugauguuau

SEQ ID NO: 2248865 - RNA, 128 nt, Homo sapiens
gaagggacuuggaccccaagccucauaaugcuguguuuuuuggagacuuacagaggcacugucucgguggucuuugauaagauccagaagaauuaucuggauuaugaggcagugacucuuguuucuuu

SEQ ID NO: 2248866 - RNA, 58 nt, Homo sapiens
ugagacggagucucgcucugucgcccaggcuggagcgcaguggcucgaucuccgcuca

SEQ ID NO: 2248867 - RNA, 80 nt, Homo sapiens
agggaauaaagcagauguguugaaaguacuaugacuuuauugaguguuuaguguguaucaagcaucaugcuaaguuccuu

SEQ ID NO: 2248868 - RNA, 67 nt, Homo sapiens
augucugagauaggauucacuuucaugucuuuauucagggcacagagugcuagucccaucuggauau

SEQ ID NO: 2248869 - RNA, 64 nt, Homo sapiens
uuucuuauggcuguagaccuuguuuuuguucaugaauguuagcaagauccagucgcacaggaag

SEQ ID NO: 2248870 - RNA, 71 nt, Homo sapiens
ucacuucuuuugugauucuucaguuacuucaggccaucuggauguauauguguaggucacaggggauauga

SEQ ID NO: 2248871 - RNA, 68 nt, Homo sapiens
guugguaaguuuggggcuaauuuguuaugcagcaaaagauaacaaauauagcguugggcuucauggac

SEQ ID NO: 2248872 - RNA, 72 nt, Homo sapiens
ggcucccuauuagauuucaccauaaugcauagaaguuagaacuuucucugguuuguggaaucuuaggaagcc

SEQ ID NO: 2248873 - RNA, 55 nt, Homo sapiens
cucagucuaugauacuuugcuaugguagcuugagcaaaguaaugcaugggcugag

SEQ ID NO: 2248874 - RNA, 73 nt, Homo sapiens
gugaaguuuuugugaggccuaaagaauaaauuuaauuuucucuggguacauuugucucauguaauaacuuuau

SEQ ID NO: 2248875 - RNA, 79 nt, Homo sapiens
gggcuuaugaucuggagguuuuccucaugacugcaggcaggaucucuuuuucaugcaggaccaccccagcaucaagcuc

SEQ ID NO: 2248876 - RNA, 66 nt, Homo sapiens
gcagcauucaugcaggcuacucacuccucuaucaucaugauacuggguucccuaagcgcaugcugc

SEQ ID NO: 2248877 - RNA, 55 nt, Homo sapiens
gacccuguugggguuuagggcuuguaaguauacauuuuauuuuagagacaggguc

SEQ ID NO: 2248878 - RNA, 69 nt, Homo sapiens
gcuugagcccaggaguugaaggcagugagcuauaaucacucuacuguacuccauccugggugacagagu

SEQ ID NO: 2248879 - RNA, 57 nt, Homo sapiens
guaggcacugaguguuuuacagggacccucauugagugagaccuuaugugcccuuac

SEQ ID NO: 2248880 - RNA, 69 nt, Homo sapiens
gaggugguucaucaggcuuucucuagagagugaccugcuuuuguggaugaauguuuggauguaagccuc

SEQ ID NO: 2248881 - RNA, 67 nt, Homo sapiens
aagcugguuuuauaucugugaggucucaaguacucucugccuuuuaggacagauguagauccgguuu

SEQ ID NO: 2248882 - RNA, 77 nt, Homo sapiens
caucucauucaauaggauuguuuaauccauucauauuuaauuaugauggauguaauugauucauguuggccaggaug

SEQ ID NO: 2248883 - RNA, 79 nt, Homo sapiens
uguuuuaaaagcagcucaagacuuaaauuugaguugaaaauuucuuauagcaaaugugacuuuugggcuucuaaaaaca

SEQ ID NO: 2248884 - RNA, 55 nt, Homo sapiens
acccagaauucagucuuaggccacaaugauaaagggcuuauuucugguuuugggu

SEQ ID NO: 2248885 - RNA, 123 nt, Homo sapiens
aaauguauugugugugucuguucuaaugugucuggagucugacugacacaaggcacuccucuucuguuuugccuaagucagauccaaggccaaaaaaagcuuaaaaacauuucaaacccauuu

SEQ ID NO: 2248886 - RNA, 60 nt, Homo sapiens
auaaucacacccagguuaaaugggguguccgucaccucaagcauuuauccuuuguguuau

SEQ ID NO: 2248887 - RNA, 57 nt, Homo sapiens
uggcaagagauaugugucuauauucauucuucugcauauggauauccuguuuugcca

SEQ ID NO: 2248888 - RNA, 58 nt, Homo sapiens
gcuggaguccaguggugcaaucauaguucacuguaaccuuguacuccugggcucaagc

SEQ ID NO: 2248889 - RNA, 55 nt, Homo sapiens
auauuugcagcuacuuauguuagaaaaguuaauuuagcagcguuguugcaaaugu

SEQ ID NO: 2248890 - RNA, 55 nt, Homo sapiens
uugagucaacuccgagagcucugccuuaaguggcugagaccugagauucacucaa

SEQ ID NO: 2248891 - RNA, 88 nt, Homo sapiens
ucucuaucaccuuccuugggaaugcuaaaccucuauuuucucaugcauaaauggggauauuagcacuucccucauaggucagugggga

SEQ ID NO: 2248892 - RNA, 102 nt, Homo sapiens
cucuguucaugacaugagaaaaacagaaccauuagagggagauauucaaacuggguucuucucacccugggguucaaauaguuuccuaugggauguucagag

SEQ ID NO: 2248893 - RNA, 73 nt, Homo sapiens
aguagugauugguugaaaguagaauacuauauuaacauuuuagucaauucuuuucaacucaagcaaaacuacu

SEQ ID NO: 2248894 - RNA, 89 nt, Homo sapiens
ggagaaucacuugagcccgggaggugaagguugcagugagccaagaucgcaccauugcacuccagccugggcagcaagagugaaacucc

SEQ ID NO: 2248895 - RNA, 72 nt, Homo sapiens
cacugcuaagugugacagggaacauuagaaaacacuguuagauauuuuguuucuacugucucuguaguagug

SEQ ID NO: 2248896 - RNA, 79 nt, Homo sapiens
ucugcguauagucucauagaauggggaaucacuucucccuagagaugguccccaauacuucuauagacuuugacucaga

SEQ ID NO: 2248897 - RNA, 57 nt, Homo sapiens
agagaaauguacaguggaucauaugauucuuucaguuugagcucaugacauuuuucu

SEQ ID NO: 2248898 - RNA, 57 nt, Homo sapiens
ucagucauucaauuguugaaugccugucauguguaggcauuaagaauaaaaugcuga

SEQ ID NO: 2248899 - RNA, 55 nt, Homo sapiens
ugaucucagcucagugcaaccucugccucccggguucaagugauagcugggauua

SEQ ID NO: 2248900 - RNA, 89 nt, Homo sapiens
gggaacuuauucaaucauuuaaucuggcucaugagcauuucuuggugcucuggugcuggugauucagauucaaauccaacaagauuccu

SEQ ID NO: 2248901 - RNA, 90 nt, Homo sapiens
cuuggauaugucuuuaucagcagugugaaaauggacuaauagaguaaauuuguauuaguagaguggggcgcugcugaaaagacauccaag

SEQ ID NO: 2248902 - RNA, 76 nt, Homo sapiens
guauugcugccuggcaaaaagagggcaauaauaaaugcuaguuauuguugguuuuuaguuuuguguggugguaaac

SEQ ID NO: 2248903 - RNA, 73 nt, Homo sapiens
ucucuggcuuuuaacaucuauaaauaagguagggugcuaaugcugcuccauuuuguagaugagaaaacugagg

SEQ ID NO: 2248904 - RNA, 77 nt, Homo sapiens
agucauguuguucugagauuucagauaguucaugcacuuggcccucugagccacugacuuaggccucaacuaugacu

SEQ ID NO: 2248905 - RNA, 66 nt, Homo sapiens
uugccauguguguaaggugcugugaacugugagugcugaagauucgcagcauucaauaccaggcag

SEQ ID NO: 2248906 - RNA, 91 nt, Homo sapiens
cugaguuauucuauaucauggagauuaacauuccaagcuucauuuccauuuguggaaugguaaacuuccaugacuguuaaagguauuucag

SEQ ID NO: 2248907 - RNA, 59 nt, Homo sapiens
ggauuccauuagcugagauaucuugugauagggagagguaucacaguagaauaggaucu

SEQ ID NO: 2248908 - RNA, 74 nt, Homo sapiens
uuauguccuuuaacuucaucacaagcacaagaaagauuaguacauuuugcaggugaggagucugaagcacauaa

SEQ ID NO: 2248909 - RNA, 74 nt, Homo sapiens
aauucccuuaaugcuugguuguuuggaaaauauuuuauuuuccuuucccuuaugaaguuuaguuaggugggauu

SEQ ID NO: 2248910 - RNA, 58 nt, Homo sapiens
uuuugaaagacaucaccuacugcucaauaccugguugaggcagauugucucuucagaa

SEQ ID NO: 2248911 - RNA, 60 nt, Homo sapiens
agucuccaccucuggggcucaagcgauucucccaccucauccucccuaguagcugggacu

SEQ ID NO: 2248912 - RNA, 55 nt, Homo sapiens
uugagauggagucucguucugucacccaggcuggagcgcaguggcaccaucucag

SEQ ID NO: 2248913 - RNA, 84 nt, Homo sapiens
guucuguguucacgaauccauuugccgucuauccauuuugcuauacgagauguuaguuacaaauggugcccuuugaacuggagc

SEQ ID NO: 2248914 - RNA, 100 nt, Homo sapiens
auguaugauuccauuauuuuuaagugcauagacagguguguguguguguauguacacagugucuguguauuuaaaauccaaaccaaaugggaucagacau

SEQ ID NO: 2248915 - RNA, 74 nt, Homo sapiens
gcauuuuguaagucucucuuguuagacuggugaacaaaguggagaggugaggcaagaagagaguuuaaacaugc

SEQ ID NO: 2248916 - RNA, 61 nt, Homo sapiens
uuucuaugagcacuuguugcuuuuaaauuguuuaaauugaaguauagcaugcacauggaaa

SEQ ID NO: 2248917 - RNA, 81 nt, Homo sapiens
acagaaccuucccaauauuccauuugggucaggaugauaucacaaugauuuugauuuaauggauaauguagaguguucugu

SEQ ID NO: 2248918 - RNA, 60 nt, Homo sapiens
guccuguccuuaaauuuauuuugugggauaaucguauaaaguaauuucuaggggcugggc

SEQ ID NO: 2248919 - RNA, 66 nt, Homo sapiens
aguugacauauauaaagugcuuggaacagugcuuagcauuuagucaguacucuauaagugccagcu

SEQ ID NO: 2248920 - RNA, 76 nt, Homo sapiens
ccaucacacugugauuauuauccccauuuuccagaugagcagacggaagccuaggaagauugagucacugugaugg

SEQ ID NO: 2248921 - RNA, 61 nt, Homo sapiens
ccucagauguguaucuguacauuauuuuucuuaaugauauugaacacuuucauaugugagg

SEQ ID NO: 2248922 - RNA, 85 nt, Homo sapiens
auuuuaucagaugcgauuauuaugucacuuccucugggccacaguauacccaaauucaggagugaugaugauguauuuuuaaaau

SEQ ID NO: 2248923 - RNA, 88 nt, Homo sapiens
acagcacaggggcaguagaaugaguuccuuugagccugagaggcauagagaagucucaaggaacagggacaacucagccaugugcugu

SEQ ID NO: 2248924 - RNA, 122 nt, Homo sapiens
gugaggcuggagggggagucugggggaggaggugaggcuagauggggauguguccagggcagguagccuugagaccccuuuauuuagccccagcucagggaacccucccacaguggccuugc

SEQ ID NO: 2248925 - RNA, 78 nt, Homo sapiens
ucuagaaaaaacugucuucugacaguuuccucugaaaaauuuaaagggagacaagcagaugagcaguugaauuuugga

SEQ ID NO: 2248926 - RNA, 73 nt, Homo sapiens
uuugguguguaaaugacucauuuuggguaauucuguaaaggccaccuaugaaugugagucauuaguaaccaaa

SEQ ID NO: 2248927 - RNA, 60 nt, Homo sapiens
gcugacacugggcuauagaucuguguguucugcaaaagcagguaguaucucauugucagc

SEQ ID NO: 2248928 - RNA, 61 nt, Homo sapiens
ggugugcugaccccaggccaucuugccccaaggagguuuaagcugugucuugucagcuacc

SEQ ID NO: 2248929 - RNA, 70 nt, Homo sapiens
ucuuuauagcaguguaagaaucgaguaacacagaaaauugguacugaggagugagccauugcuauaaaga

SEQ ID NO: 2248930 - RNA, 77 nt, Homo sapiens
ucacuugaaccucggagguggagauugcagugagccaagauagugccauugcacuccagcccuggcaacaagaguga

SEQ ID NO: 2248931 - RNA, 88 nt, Homo sapiens
ggcaggaagccaacuugcaaacaucuuguuucacauuucagcaauaagcccaaaaugaaagcaugaguuuucagagggaucuccugcu

SEQ ID NO: 2248932 - RNA, 86 nt, Homo sapiens
gagaaucgcuugaacccgggaaguggagguugcagugagccaagauugcacuguugcacuccagccugggcaacagggcgaggcuc

SEQ ID NO: 2248933 - RNA, 112 nt, Homo sapiens
gacauugggaaacugucaugugaguugcuuagucaugaaucacugauuggaauaugguucuucagugcuuccccuggcuaaagcacaggcucaaagcuauguuguccauguc

SEQ ID NO: 2248934 - RNA, 57 nt, Homo sapiens
aucugagcauauugugauaccuaaaagcaaaagcauuuguuaucuuguaugccagau

SEQ ID NO: 2248935 - RNA, 73 nt, Homo sapiens
aaggcaugauuguauuuugcucugugauaaggacaugagauucugggauaucaggguaagaauaauaugguuu

SEQ ID NO: 2248936 - RNA, 97 nt, Homo sapiens
cugcgaacugaacuggucuuuggaggaggaggguucagcaaaauuuuaauuacagguugucuguccugcuuuuaauggcuaggcucugcaaacguag

SEQ ID NO: 2248937 - RNA, 82 nt, Homo sapiens
uuugcguaucuauguguuuuauggucagggagauggggaauaucuguuugucuccgcuaugguagcuaugguauuauguaga

SEQ ID NO: 2248938 - RNA, 59 nt, Homo sapiens
ugagacggaguuucacucuugucacccaggcuggagugcaagggugugaucuccgcuca

SEQ ID NO: 2248939 - RNA, 56 nt, Homo sapiens
gaacacauguucaugacuggcugugauguauaggucuugucauagaaugaugguuc

SEQ ID NO: 2248940 - RNA, 78 nt, Homo sapiens
ucuguuguucagagaagaaagugacuauaauaggguaagcuacuaaggcacaauuuucucauacuaguagacaacaga

SEQ ID NO: 2248941 - RNA, 78 nt, Homo sapiens
guguugcccauaggaagaauugugacauaucacugaacccagaaccuaugugaugugacuuuuuccugugccuuacau

SEQ ID NO: 2248942 - RNA, 80 nt, Homo sapiens
ccaagaauagggcacgagaugugagccugccaaggguacucccaggucuggcaucuugguucuuuccgcugcguucuugg

SEQ ID NO: 2248943 - RNA, 77 nt, Homo sapiens
gggacuguggcgccuucaaaccucagguucuugauguguuuuaggaaucuguagaaggugcacauucaugaggucuu

SEQ ID NO: 2248944 - RNA, 72 nt, Homo sapiens
aucuuagagcaaugggugaauauuaaauaauaaaacaauuuauuucuuauuuauucaauguuaagugaaggu

SEQ ID NO: 2248945 - RNA, 70 nt, Homo sapiens
uauuuguuagugaaugcaccacuucugacuacugcuccaagggguuagauggauaauucuuuaggaagug

SEQ ID NO: 2248946 - RNA, 83 nt, Homo sapiens
ucuccauuuguaaggguuucucccacugugcaccagaauaagaauggugacucuaaauuacuggagacucuuaucaauggaga

SEQ ID NO: 2248947 - RNA, 58 nt, Homo sapiens
uggcuagaccugcauaacagcuaccgcuuuaaaggggagccuguuguccaguuugcca

SEQ ID NO: 2248948 - RNA, 100 nt, Homo sapiens
gcagaccuccauucugaguggugagauguucagacgaacuggucagagauucugcucuagagguuauacaauauuuugaacaucacucauggguguuugu

SEQ ID NO: 2248949 - RNA, 109 nt, Homo sapiens
ugcagccaggacgucugaagaaaguucagggcauuggcugguaccuggaugagaagaaccuggcucagguguccaccaaucuucuggacuuugaggucacggcacugca

SEQ ID NO: 2248950 - RNA, 129 nt, Homo sapiens
agcuguguuuuuucugcuucuuauaguccaucaucaccaguaauaaagagccugcaaauuugucagccaaguccugacaguaaaaucuuuauugcuggugaugauguaagaggcuaaagggacacagcu

SEQ ID NO: 2248951 - RNA, 99 nt, Homo sapiens
gaggcaggagaaucacuugaucccaggagauggagguugcagugaaccgagaucaugcuguugcacuccauccugggcgacagggcaagacuccgucuc

SEQ ID NO: 2248952 - RNA, 97 nt, Homo sapiens
uuaucuuaacacucugagguaaguauguuauuacuuuuuauagaugaggaaaccaaaguuaagagguuacauaacuugccugagauugcaaagauag

SEQ ID NO: 2248953 - RNA, 71 nt, Homo sapiens
auacuuuccuuuaggaagucaauuccuguuucaagcuaugcaucaggaagugucuucuuuuaggcaaguau

SEQ ID NO: 2248954 - RNA, 102 nt, Homo sapiens
gggcagcaaaaacauccauuccgcugcgcaacaguugucauuuuucuaacaucugaaaacuccagaaggagauggugauaaaugugguaccggauucugccu

SEQ ID NO: 2248955 - RNA, 81 nt, Homo sapiens
ucuguaacugcauuugguggaucgugcugaaauacaucgcauaggcuuguaaacucaguauguuuuacuuccaucuacaga

SEQ ID NO: 2248956 - RNA, 80 nt, Homo sapiens
gcuauuucaggaccauacaugugcaaugauaaauaauccugcuggguauguuaucacacaucaugguaaaucugagaagc

SEQ ID NO: 2248957 - RNA, 72 nt, Homo sapiens
gguguggucacuuccggguuguugccauggcauuuguaaucugucauggcacuggugggagugucuuaugcc

SEQ ID NO: 2248958 - RNA, 79 nt, Homo sapiens
ucauuuuuaccagccacucuaggugauucugaugccuguguucugguguacagaauugcagguguggcagggaagaugg

SEQ ID NO: 2248959 - RNA, 88 nt, Homo sapiens
uacauauuagucauuuaaacacucacuucauagccauuauugucaaaacaacaugugugcuuuggguguggguguguacagguaugua

SEQ ID NO: 2248960 - RNA, 69 nt, Homo sapiens
gauuccacagucuuugcuuuuaaccagagguuagcaaacuacuucuguaaagggaagacaguagguauc

SEQ ID NO: 2248961 - RNA, 79 nt, Homo sapiens
guguccccugcguggguaggcaagcggaugucagagaggcaccgaacucucugccuuugucuugccugccuagggaugc

SEQ ID NO: 2248962 - RNA, 99 nt, Homo sapiens
aggaagcaagaauguaaugaggaugaaguguuuggaaguuuaagaaaagggaucaaaaagucaguaauucucugaaacucuugacauccuuuguuuccu

SEQ ID NO: 2248963 - RNA, 61 nt, Homo sapiens
ggagaugauuugccccauguauuuucuagaguccaaugaaagacugggugaaucacuuucu

SEQ ID NO: 2248964 - RNA, 78 nt, Homo sapiens
ccaucugugggcuucaacacagucaguuccuggaucaacaaacauuuauucagcaccugcuguguuccaggcauaugg

SEQ ID NO: 2248965 - RNA, 55 nt, Homo sapiens
cuggaugagauuaacauuugaggagcugcguggcggcucacaccuguaaucccag

SEQ ID NO: 2248966 - RNA, 98 nt, Homo sapiens
guagcauaggucuggugucaaugaaaucucuuuugucugucuggaaaggucuuuauuuuuccuucaugcuugaaggguauuuucaccagauauacuac

SEQ ID NO: 2248967 - RNA, 77 nt, Homo sapiens
ugcgcguccaugugaaaagaccaccaaacaggcuuugugugagcaacauggcuguuuauuucaccuggaugcaggca

SEQ ID NO: 2248968 - RNA, 76 nt, Homo sapiens
cugagagggaguuauucacaguguguacaccagggggcaucuuagaauucucccuaccacaaugugucuucauuag

SEQ ID NO: 2248969 - RNA, 84 nt, Homo sapiens
ucauuauuaucacuacuuaaugugaacagcuaucuugucaguguauacauauacugauucaaagcuguuggcuuaauauaauga

SEQ ID NO: 2248970 - RNA, 70 nt, Homo sapiens
gcuuguuggaaguaaacauuuuguacaauaauguuaggagguaacauuuguugaacaguguuucucaggc

SEQ ID NO: 2248971 - RNA, 99 nt, Homo sapiens
gauccuggccaaagugucaauugugacaaggcugagaaaccuugucuuauucuacuuucaccaguuuugucacgaauguucuuuuuugguuccaggauc

SEQ ID NO: 2248972 - RNA, 86 nt, Homo sapiens
gagaauugcuugagcccaggagguggagguugcugugagccaagaucgcaccauugcacuccaaccugggcaacagagcgagacuc

SEQ ID NO: 2248973 - RNA, 90 nt, Homo sapiens
aguucuuuuucagccgggcaugguugcuuauuccuguaaucccaguauuuugggaaacugaggugggcagauugccugagcucaggagcu

SEQ ID NO: 2248974 - RNA, 57 nt, Homo sapiens
gcauggcaauaugaugcacuguuugcgggaguccugcgagggcacauuguuccgugc

SEQ ID NO: 2248975 - RNA, 57 nt, Homo sapiens
ugaauguaacuaaaggacuuuucauccuuuccuggagaaggggcuaguguauguuca

SEQ ID NO: 2248976 - RNA, 57 nt, Homo sapiens
cuggauauguugcaacauuucccacuaauuacuuggugacuggugucagauguccag

SEQ ID NO: 2248977 - RNA, 70 nt, Homo sapiens
auauccucuccagcaccaguuguuuccugacuuuuuauugaucgccauucuaacuggugugagaugauau

SEQ ID NO: 2248978 - RNA, 80 nt, Homo sapiens
aggugagccacauaaaaucaccaauauagucccaucccaucuuugacuuacaaaaguggcaguuuuaugugguucaaccu

SEQ ID NO: 2248979 - RNA, 88 nt, Homo sapiens
cuguuuuucauuugcuugacugauuuaucuccauuuccuuauuuugagccuauggaguguaaauuaguucagccauugggaaaagcag

SEQ ID NO: 2248980 - RNA, 57 nt, Homo sapiens
gugucacuguugagaaguccacugacaguuguauugggacuucuuuuuaugugaugc

SEQ ID NO: 2248981 - RNA, 58 nt, Homo sapiens
gugaauagugcugcaauaaacauacgugugcaugugucuuuauagcagcaugauuuau

SEQ ID NO: 2248982 - RNA, 64 nt, Homo sapiens
uuuuugauguuggggcuaacagaugaugaugagacaugguuuaacaauagcuucacauuaggaa

SEQ ID NO: 2248983 - RNA, 70 nt, Homo sapiens
agggagaugagcuaaguucucacagcaagucagugacagaucugcugcuggaucuuacucaucuuacccu

SEQ ID NO: 2248984 - RNA, 60 nt, Homo sapiens
cugagaugcuagaagggggcacagugugguagaagaauuguggccuuuggagcaugucag

SEQ ID NO: 2248985 - RNA, 71 nt, Homo sapiens
ugguggcuuuugucaugaaacaccuacugugcacuggcuccgugcugggauguuuuauacugagccugccg

SEQ ID NO: 2248986 - RNA, 67 nt, Homo sapiens
uauuagguuggugcaaaaguaaucacgguuuuugcauaauggcaauuauuuuugcaccuaccuaaua

SEQ ID NO: 2248987 - RNA, 88 nt, Homo sapiens
ggagaaucgcuugaacccaggaggcgcagguugcagugagccgagaucaugccauugcacuccagccugggugacagagugagacucc

SEQ ID NO: 2248988 - RNA, 62 nt, Homo sapiens
ggaaaaggggauuaagggaaaguuuacgugcugcauggugagacacuucccagaucccuucc

SEQ ID NO: 2248989 - RNA, 95 nt, Homo sapiens
cagaagacuacuauuacauauucucccucauaugcaggagcuuaaaaaguugaucucaugaagguggagaguaggauaaugguuaccagagucug

SEQ ID NO: 2248990 - RNA, 100 nt, Homo sapiens
uaggacaacauuucuuuuuguagcuuuugagauuuauauuucuguuggguguuaaaauuucaaaggugaguaacuauuuacaugagggccaauugguuua

SEQ ID NO: 2248991 - RNA, 97 nt, Homo sapiens
gccuccauaggagagugugugauguaaagaacuggggauguagcaguucaguuacugcaauuccucagcuuuuauuucacuugccuuuuagaugggc

SEQ ID NO: 2248992 - RNA, 55 nt, Homo sapiens
uguagccuacuucacaccuaggcuguauggcauaaccuaguguucuuaggcugca

SEQ ID NO: 2248993 - RNA, 78 nt, Homo sapiens
gugauguugagauguauguauauaauguguagugaucagauaagguuaauuagcauacauagcaucucaaacauuuac

SEQ ID NO: 2248994 - RNA, 100 nt, Homo sapiens
gaggcaggagaaucguuugaaccugggaugcggagguugcggugaguggauauugcgccauugcacugcagcccgggcaacaagagcgaaacuccgucuc

SEQ ID NO: 2248995 - RNA, 75 nt, Homo sapiens
acuuugguuuauagaauuuaggaaaagauaccugaccaagagaaacaggaaucauggaauucagugggccagagu

SEQ ID NO: 2248996 - RNA, 60 nt, Homo sapiens
ggagauguccuaagugguuaacucuauugaaagggucacauaagugcauaggauauuucu

SEQ ID NO: 2248997 - RNA, 60 nt, Homo sapiens
ggucuaaugaggagaaaaaaggaaagagaucaauucagaucuccuucauuccuuuggacc

SEQ ID NO: 2248998 - RNA, 89 nt, Homo sapiens
gcauuagauucuuacaggagcaugaacccuauugugaacugugcaugugagggauauagguuguugcaugcuccuuaggagacuaaugc

SEQ ID NO: 2248999 - RNA, 56 nt, Homo sapiens
ggugggacugugucuuauucaucuuuguacucugguugcuuaacacaguucccacc

SEQ ID NO: 2249000 - RNA, 71 nt, Homo sapiens
ucacaggguggaagacauugggugaaggguacucaggaccuuucuguacuauguuuugcaacuuuuuguga

SEQ ID NO: 2249001 - RNA, 61 nt, Homo sapiens
ggccuaacaguauugcuuuuaacccaaucucuuuuauaugaaagaaggcagaauugaggcu

SEQ ID NO: 2249002 - RNA, 81 nt, Homo sapiens
aggcauuugcaucuagggcaacccagagcuucccuagccuuaagcuuuccuuuagcugguuguucuggaugggcaggguuu

SEQ ID NO: 2249003 - RNA, 72 nt, Homo sapiens
uaaaaugacauugauaguuuaauaggaauugcauuaaaucuguagauugcuuuggacugucuggccauuuug

SEQ ID NO: 2249004 - RNA, 89 nt, Homo sapiens
ggcauauauauuagauucaaaaucacaaagagcugccuuuaagauuuucucuuaagcauugacuuuggacagucugguggcuaugugcc

SEQ ID NO: 2249005 - RNA, 76 nt, Homo sapiens
gugugcacaugugcaugagcacauacgugcaugcacacacaugcacacacaugcgcacaugcauacacacgcgcac

SEQ ID NO: 2249006 - RNA, 58 nt, Homo sapiens
gccugggaggucgaggcuguggugagccaucauaacacuacugcacuccaaccuaggc

SEQ ID NO: 2249007 - RNA, 56 nt, Homo sapiens
uguagucaugugccaccgcauagcaacauauaugcugguggucccauaugauuaua

SEQ ID NO: 2249008 - RNA, 63 nt, Homo sapiens
gcgggggcugugcauuccucucuucccgacaugcucugagauguggaaugcaccaguccuugc

SEQ ID NO: 2249009 - RNA, 88 nt, Homo sapiens
aauaauucuggggauaauauugucaaaauggauuccacugcaaacaggcaguaggauuuacuuugacaauauucuccccagaauuauu

SEQ ID NO: 2249010 - RNA, 55 nt, Homo sapiens
cccagagauggaggcuguagugaaccgagaucacacuacugcacuccagucuggg

SEQ ID NO: 2249011 - RNA, 57 nt, Homo sapiens
acuagcugggugucguggugcacaccuguagugucaccaguggcacuccagccuggu

SEQ ID NO: 2249012 - RNA, 78 nt, Homo sapiens
uucugaaugccaguuagcaaaauuuuucaaauauuuuuauagugccaagaaagugcugcuugacugggauuauuagga

SEQ ID NO: 2249013 - RNA, 56 nt, Homo sapiens
gagagcaagaugcaaauggaggcuuaauaagagcuugcauauuggaacuuucucuc

SEQ ID NO: 2249014 - RNA, 71 nt, Homo sapiens
uauggcuuucuacuugaguucuagccuguccaugccaaaugagcaguagaggacuuaagugaaaagccaua

SEQ ID NO: 2249015 - RNA, 58 nt, Homo sapiens
gucacaaggagccuaguuaaaucucauuuauaaugccuuaacuguggcuucuuuuggc

SEQ ID NO: 2249016 - RNA, 60 nt, Homo sapiens
ugauuugucucucagcccuacuuaaaaagaaauccuaggaaggcugaaguggaaagauca

SEQ ID NO: 2249017 - RNA, 59 nt, Homo sapiens
auauagcaaugaaagagaugaacuugcaacaacauggaaaaaucucacaauugcuauau

SEQ ID NO: 2249018 - RNA, 85 nt, Homo sapiens
uauuuagauagucauaugguuuuauguucuucauucuacugauaugaugauauaugacauggaaccaugcuugcuuucuuggaua

SEQ ID NO: 2249019 - RNA, 67 nt, Homo sapiens
uugaggaggcaguguguccguucucggaguuggaacgccacgcugagagaaccacugcucucuucag

SEQ ID NO: 2249020 - RNA, 102 nt, Homo sapiens
caugaacugggagcucuagcacaugaauaguggguaaugaugggaaguagccacauucccguuauuaaccccugccuucccuguuagcuuccugcuuacaug

SEQ ID NO: 2249021 - RNA, 92 nt, Homo sapiens
cacugagccgccugcauggaggaggggcgccugcacucugugucuuuggccggauguggcacuugacuuucucgcaccuguggcacucagug

SEQ ID NO: 2249022 - RNA, 120 nt, Homo sapiens
uuuuuuuuuuuuugagauggaaucuugcucugucgcccaggcuggagugcagugggccgagaucacaccauugcacuccagccugggugagagugagacuccauuucaaaaaaaaaagag

SEQ ID NO: 2249023 - RNA, 65 nt, Homo sapiens
auguguaugguuguuguagagagaacaguagaacagauuuuucuguccaggcuuacuauauauau

SEQ ID NO: 2249024 - RNA, 64 nt, Homo sapiens
cuggucaaccuugugugaaggcaaguccugcauugccuaacaggcaauauugccuucagacuag

SEQ ID NO: 2249025 - RNA, 55 nt, Homo sapiens
cuacacaaauuuggguagcuuuaggucuuuuaaaaaauagcucauguuuguguag

SEQ ID NO: 2249026 - RNA, 86 nt, Homo sapiens
uuuuaauauggccuggauauuagauguuauuagggaauucuuuuucauuaucuuaggugugaucauuguauugggguuauuuagga

SEQ ID NO: 2249027 - RNA, 64 nt, Homo sapiens
acugugaauagugucacaauaaacauacgugugcaugugucuuuauaacagcaugauuuauagu

SEQ ID NO: 2249028 - RNA, 65 nt, Homo sapiens
aggaagucaggaggugaaggagaaccagugcuaccaucuggcguuuacuuccuuccugucuuuuu

SEQ ID NO: 2249029 - RNA, 94 nt, Homo sapiens
ggcacgagaaucgcuugaaccuugaagguggagguugcagugaacaagauugugucacugcacuccagccugggcaacagagugagacucuguc

SEQ ID NO: 2249030 - RNA, 55 nt, Homo sapiens
agguguaaaucugcugugaacauuuuuauuaaaaaugucccccagguuuauaucu

SEQ ID NO: 2249031 - RNA, 62 nt, Homo sapiens
ggcagaagccuagcucuguguguguaguggcaacaacagcacaguuaaaugaggcuucugcu

SEQ ID NO: 2249032 - RNA, 63 nt, Homo sapiens
ugaaaguagaguuuaugcauguugugaauuuuuuuuccauagaauguauaauauuuuacuuca

SEQ ID NO: 2249033 - RNA, 101 nt, Homo sapiens
guggaaacugaaguccagguuuaccucucaacuucuauugucguacuacaggagucguucuuuuuacucuuugguaggaguaggaggccuggcuuccccac

SEQ ID NO: 2249034 - RNA, 55 nt, Homo sapiens
uugagauggaguuucacucugucacucaggcuggagugcaauggcaccaucucgg

SEQ ID NO: 2249035 - RNA, 69 nt, Homo sapiens
cuuucugggggugcugauggaaacuccuacccaggcaaaucuuguuucccaggcauucccccagugaag

SEQ ID NO: 2249036 - RNA, 114 nt, Homo sapiens
agaguuaaacuaagcauucaguauguguguguguguguguguguguguguguguguguguguguguacguacaugcauacaugcacaucuguuguggaaugccuguuucucucu

SEQ ID NO: 2249037 - RNA, 87 nt, Homo sapiens
acauaugugugaauuuuaggcuuuuuuucccaaggugagcugaaggaagacuuauaacuagagauaguuuccaacucauacugaugu

SEQ ID NO: 2249038 - RNA, 74 nt, Homo sapiens
uggauucaccuaacuaguaguuucuugagaauuuuugcaucuauguucaucagggacacugguuuguaauuuca

SEQ ID NO: 2249039 - RNA, 67 nt, Homo sapiens
cugagcuaugccuggaaaggcagcugggaaaaauuaaaaccacaucuucuugucagguagaguucag

SEQ ID NO: 2249040 - RNA, 81 nt, Homo sapiens
uaggaguuauuuguuccuugagagcuugauaucacuugaagcaucugugucuauuuacuuuuaggagauagauuucuuuua

SEQ ID NO: 2249041 - RNA, 124 nt, Homo sapiens
uuguuuauaaauuacccaggcucagguaucuucauuauagcagugugaaaauggacuaauauagagaauugguacugguagagagaggcauugcuauaaggauaaccugaaaauguggaagcaa

SEQ ID NO: 2249042 - RNA, 78 nt, Homo sapiens
uagagcaaacaccuguguauacauucauuuauucaaugacuauuuauugaacacuucugugugccagguccuguucua

SEQ ID NO: 2249043 - RNA, 83 nt, Homo sapiens
aaguuauauguaaggcucuuucaacguaaauuaagcuggauuaagaugaccaaauuagaguaugaagagauugccuuagacuu

SEQ ID NO: 2249044 - RNA, 66 nt, Homo sapiens
uggagaacugaugucuccaagaagugcuuuacagucagaaaguucuggagucauuucaguuuuuca

SEQ ID NO: 2249045 - RNA, 79 nt, Homo sapiens
aauauguaugugaggucacuuguuuuaugcuuccaguguacuuucaggagcauaaaacaugugaccugauguacauauu

SEQ ID NO: 2249046 - RNA, 60 nt, Homo sapiens
acaucuguacagugggugugguagcucccaugaucuucaggggccacaccacucagaugu

SEQ ID NO: 2249047 - RNA, 108 nt, Homo sapiens
cuauguccuagucuauuucaguuuucucucaaguagugguuuucauugaacuaccaaaaaguugcaagggcaaccacacuugaagaaaaacguguuaguaacauauag

SEQ ID NO: 2249048 - RNA, 68 nt, Homo sapiens
aacuucccugcccaacugucaagucucagccagaggcauacucagaguugacagugacagguaaaguu

SEQ ID NO: 2249049 - RNA, 74 nt, Homo sapiens
gggguugccccuggcauugaguggguaggagucagggaugcugcuuaacauucuacagugcacaggacagcccc

SEQ ID NO: 2249050 - RNA, 60 nt, Homo sapiens
guuugccaguguuuuguugaagauuuuugcaucaauguucaucaaagauauuggccugac

SEQ ID NO: 2249051 - RNA, 89 nt, Homo sapiens
gaagagugucauuguuauuuugauaaggauuacauuggaucuauagaucacuuuggauagugugguccuuuuaacaauauuaauucuuc

SEQ ID NO: 2249052 - RNA, 94 nt, Homo sapiens
auuuguauugcuugaagagugaauucugguuccaaauguuuauuaaccguguguucccaugccugagucucacuuucuucauguauaugcagau

SEQ ID NO: 2249053 - RNA, 130 nt, Homo sapiens
cuuucuuugaagcaucauauauuuuagguugguguaacaguaauugcaguuuuugccauugaaaguaauggcaaaaaucacaaguaccuuuguaccaacauaacagauaagaaaauucaucagaagaaag

SEQ ID NO: 2249054 - RNA, 92 nt, Homo sapiens
uuuucugcacugaugucuacaguugugaaaaugcaccuguguacucauguagcagcauauuuuuauaauguauauuuuuagcagugagagaa

SEQ ID NO: 2249055 - RNA, 62 nt, Homo sapiens
gguuguccaagucccauuuguugaaaagacuguucuucucccacugaauggucuuggcaacc

SEQ ID NO: 2249056 - RNA, 66 nt, Homo sapiens
uaucacagugcuggaguauuccaugugugaaaucauuucauccucccaaugccuagcaaaguggua

SEQ ID NO: 2249057 - RNA, 74 nt, Homo sapiens
ggguuuguuaugguacuccagagaagcagaagaaauuccuucugcuucucuggaguacccuaauuuuaguaccc

SEQ ID NO: 2249058 - RNA, 106 nt, Homo sapiens
ucccaccaaaggggcaauugaugcugaugccugccagaagcacugcuucaaguuccaguguuuacccauauuagcaucaagucugccacuauucauuuuggaggga

SEQ ID NO: 2249059 - RNA, 79 nt, Homo sapiens
cugugaauuagugagaagacagguaguuuaaacggggaguaucaucccuauuuaaaccugucuucucacuaauucacag

SEQ ID NO: 2249060 - RNA, 58 nt, Homo sapiens
ugugugguuuucauauaaucacuccaagcaaaugcgcugaucacaugaaaaccaugca

SEQ ID NO: 2249061 - RNA, 87 nt, Homo sapiens
gucacuaugcaaagcacuuggcuuggaagaucucauuuaauccucacaagaaucuccagaaauaaguauuuuuagcacauaggugac

SEQ ID NO: 2249062 - RNA, 112 nt, Homo sapiens
ugaguucccuaaggaagguguaguugacguuauuguccacuuugcacuguguucuuguguguauggggaugagguggggguggauaagagaagucacccaggaaggagcuca

SEQ ID NO: 2249063 - RNA, 100 nt, Homo sapiens
cagaacaggccgugcaguccugcugagcacagagccugggguggcccaaccgaccuuugaggccauuccaacagucuggcagcaucugcaguggucucug

SEQ ID NO: 2249064 - RNA, 86 nt, Homo sapiens
cggcagagccuggauugaacucagcauccagggccaagggggaagcacuggcuuggccauugaugcucaguuccuccuucuugcug

SEQ ID NO: 2249065 - RNA, 77 nt, Homo sapiens
caucacauauucucacuuauuucuggguuccaaaaaucacaauaauuuaacucauggagauagagaauagaagggug

SEQ ID NO: 2249066 - RNA, 80 nt, Homo sapiens
uuuugcuuaguaaauguagaaaaaugagggaaauaaggaaucaucauuaaaacucuacauuagaauugguacaggcaaga

SEQ ID NO: 2249067 - RNA, 130 nt, Homo sapiens
acagcuaauaucacaguaaauguacaccauguguguacacccugugauauuaauaauauccuagggaaauauuacuccuaauagcacaguguguguacaccauguguguacagccugugauauuauuugu

SEQ ID NO: 2249068 - RNA, 55 nt, Homo sapiens
gcuacugcauccagccuauuuuuuuaucuuuuaaagacuagucaggugcaguggu

SEQ ID NO: 2249069 - RNA, 70 nt, Homo sapiens
gacauggauauguguaucuauguacauguacacacaugugcauccauguacauauaugcacagacauguu

SEQ ID NO: 2249070 - RNA, 63 nt, Homo sapiens
augcagacacaaguuauaguaaguuuuguguggagauggaaagaauugugugugugugugugu

SEQ ID NO: 2249071 - RNA, 64 nt, Homo sapiens
uccaaaugucuagagugauacugaagcuuugucagagaggucagcagugugauucuaacaugga

SEQ ID NO: 2249072 - RNA, 70 nt, Homo sapiens
cuguugcccaggcuggagugcaguggugcaaucuugguucgcugcgaccuccaccucccggguucaacag

SEQ ID NO: 2249073 - RNA, 56 nt, Homo sapiens
ugauauguuagaaucuugcaagauguuacuaucuugccauauuauugagcauauua

SEQ ID NO: 2249074 - RNA, 71 nt, Homo sapiens
ucaguuuuaagggugauuccugcuaagucaagaacuccuauuguugauaucugaucauccuugauaucuga

SEQ ID NO: 2249075 - RNA, 59 nt, Homo sapiens
cuugccuuagguuuagagccaauuaaaauuagguugagcuccucucaaccuaaggcaag

SEQ ID NO: 2249076 - RNA, 78 nt, Homo sapiens
uaaucacuucuagcuuuugauguaaagugagagacaugcaacucuucacuugaaugcuuagaggccacuguaggauua

SEQ ID NO: 2249077 - RNA, 83 nt, Homo sapiens
ucuuuaaagacagcaguggugucuuguuuaauauauaucucuggugccugguauauagcaaacacucauuagauauuugaaga

SEQ ID NO: 2249078 - RNA, 71 nt, Homo sapiens
ccggguaccucaguuggaaaugcagaaaucacccaucuucugcguugcucacgcugggagcuguagacugg

SEQ ID NO: 2249079 - RNA, 81 nt, Homo sapiens
guggggaacuuuugugucuaucucagggauuguaaaggcaccaaucagcacccugucaaaauagaccaaucagcucucugu

SEQ ID NO: 2249080 - RNA, 60 nt, Homo sapiens
cgcuggggaaugcagcuggggucgggggcaaacagagacauggccaguuuucccucagug

SEQ ID NO: 2249081 - RNA, 121 nt, Homo sapiens
gagggcagagauggcagcaagcauuccuuggcugaggccugcauugaacuagaaggcuguugauaaggcuuaucauggggacugcagccuagccucggauagcuccuccauccuucuccuc

SEQ ID NO: 2249082 - RNA, 66 nt, Homo sapiens
ugucauguggcuaacgauucaugccaaagguuguccgcaucuuauguaucagugaguuaucugaca

SEQ ID NO: 2249083 - RNA, 60 nt, Homo sapiens
gagggcuucuuggggccacacaguguucagauuuuauauugaauguguugggaagcccuu

SEQ ID NO: 2249084 - RNA, 84 nt, Homo sapiens
ucugcugcagcauccaaugaaagccuucuuccuuggaaauacuaauugucucagugauuggcuuucugugcaguaagcagcaga

SEQ ID NO: 2249085 - RNA, 128 nt, Homo sapiens
auuaggaacaguaucacuugagggguguaccucuacugcgauaucaggcauaauaacauccucuccccccgaauauuaagaacaauaucacagguggacugcacacccucugugauauugaaaauaau

SEQ ID NO: 2249086 - RNA, 64 nt, Homo sapiens
uugggcuagauaauuauuugugaauagggagcuuuccugugcauuguaggauguuuagcagcaa

SEQ ID NO: 2249087 - RNA, 60 nt, Homo sapiens
aucagugauugauuuaaagacgugauuggauaacacuugucuguugauugaauuacugau

SEQ ID NO: 2249088 - RNA, 57 nt, Homo sapiens
agcuucuccauuagcaggugcugcuucaccuugcauuuuuauguuauggagacagcu

SEQ ID NO: 2249089 - RNA, 98 nt, Homo sapiens
cauggaaacuaucuagaucuaguccauguuuauuuguuugacucuuucuccaucuagguuauagguuucuacaggacuauggucuauuagucacuaug

SEQ ID NO: 2249090 - RNA, 63 nt, Homo sapiens
agugcauuagaaucaccuggaaggcccuaacagccagcugggccccaguguucugauugcacu

SEQ ID NO: 2249091 - RNA, 93 nt, Homo sapiens
guugcauuuauugugacacgggguauguuccuuuugauauuauccauaauguccuagagggaugucaccccuuaugucacaggguuuguacac

SEQ ID NO: 2249092 - RNA, 60 nt, Homo sapiens
ugguaccaguaaugggucaaaggcacucuuucugaguauucuagaaaaauuacuggacua

SEQ ID NO: 2249093 - RNA, 56 nt, Homo sapiens
aguccagguuuuguaauggcaaacauacacccugcaugaccauucaccccuggacu

SEQ ID NO: 2249094 - RNA, 58 nt, Homo sapiens
agguguuuuccuuucuguugcugucauggucauugcaaacagugcugaacagacaccu

SEQ ID NO: 2249095 - RNA, 83 nt, Homo sapiens
uugcagaaacuuauauuggacugugcuaguuagaaaggcuggccuccuuucuaacuagcaugguguaauagaacuuucugcaa

SEQ ID NO: 2249096 - RNA, 76 nt, Homo sapiens
aaguacacuugaaagagggccaagggggcaacuugagagauucaagugcccuauuuggcccuugauagggagauuu

SEQ ID NO: 2249097 - RNA, 62 nt, Homo sapiens
gaaacaccacgcggucccucggaucccacucuguccugccucugagauccuuguguuguuuu

SEQ ID NO: 2249098 - RNA, 65 nt, Homo sapiens
gcacacacauaggcagcuagauacccuaaguauacuuaaaauuuaguacugcuuuaugugugugu

SEQ ID NO: 2249099 - RNA, 73 nt, Homo sapiens
gcuggugucuguuaugacacucuuuuuaucaucaaugcuuuuuaugauacaccugaguguuauaaucauuagu

SEQ ID NO: 2249100 - RNA, 87 nt, Homo sapiens
cuggguacugcauucaagugaugugauucuucuuuuuggguucugccaacaggaagcauugaacauaucacuuggcucaguaccuag

SEQ ID NO: 2249101 - RNA, 61 nt, Homo sapiens
acaggaacacacauacaguauauucucuauuugaugaaaaugaucuguuuggugaucuugu

SEQ ID NO: 2249102 - RNA, 58 nt, Homo sapiens
ucuauuuuguuuccagcucuacuuucagguccauccauagagcuuggcacagaguaga

SEQ ID NO: 2249103 - RNA, 95 nt, Homo sapiens
ggccgaggcggguggaucacuugaggucaggaguucgagaucagcauggccaacacagugaaacccgucucuacuaaaaauacaaaaaaauggcu

SEQ ID NO: 2249104 - RNA, 76 nt, Homo sapiens
aucuggcaacaucuggggacauguucaguggucauaacuggcauccagcgaacagaggccagggauguugcuagau

SEQ ID NO: 2249105 - RNA, 86 nt, Homo sapiens
ugacuggguuauuucuaaacaccugucuucaaguuuagaaauucuuucuucugcuugaucuaguguguuguugaagccuucaguua

SEQ ID NO: 2249106 - RNA, 75 nt, Homo sapiens
gaggacuuugaaacuuuaauaagagucagagaauuuuuggaacugaugacuaaaacugaguuucauuaaguucuc

SEQ ID NO: 2249107 - RNA, 81 nt, Homo sapiens
auuaggaguaacaggauccaaagaauguauugaacuucauuguuuuaguuggcaucuuugcgagccuuuuaaugaucugau

SEQ ID NO: 2249108 - RNA, 94 nt, Homo sapiens
cgcgcaggugaguccgcuggugcuugaugaggguggagcuguggccgaagcucuugccgcacucuaggcacucguagggcuucucgccugugug

SEQ ID NO: 2249109 - RNA, 62 nt, Homo sapiens
gcuaguuaguggcagagccggucagugugaugccacuuugguugugcucuccacuuugaggc

SEQ ID NO: 2249110 - RNA, 55 nt, Homo sapiens
uugagauggagucucacucugucucgcaggcuggagugcaguggcucaaucucag

SEQ ID NO: 2249111 - RNA, 56 nt, Homo sapiens
cccaggcuggaaugcagugacaugaucucagcucacugcacucuccgccuugcggg

SEQ ID NO: 2249112 - RNA, 55 nt, Homo sapiens
uacuaguaagggugguuuggcuccccaggcuguccugccaucacccuaacuagug

SEQ ID NO: 2249113 - RNA, 63 nt, Homo sapiens
cuaugugucuauguguucucaucauuuaguucccucugauaagugagaacaugugguauuugg

SEQ ID NO: 2249114 - RNA, 65 nt, Homo sapiens
uucaguucuguggcuuguaggggucaagggaaagcuuucccuucgcccucugaaaguuugcugaa

SEQ ID NO: 2249115 - RNA, 61 nt, Homo sapiens
ggaaguuccugaaguucagguaugaaaaaagcaauuggaagauacuggcucgggaauuuuc

SEQ ID NO: 2249116 - RNA, 71 nt, Homo sapiens
caggaaugacccaugaugguugcauuuggauaugucaguacaaaccuaaaugcacugucaaaggaagccug

SEQ ID NO: 2249117 - RNA, 59 nt, Homo sapiens
uuucccucucacacagcaguuuucuuuugaacugaaauauugcccaaaguggaggggaa

SEQ ID NO: 2249118 - RNA, 97 nt, Homo sapiens
gguagcuguguucucccugagguccuggauuauuggggaaggcagaaacagccccaauuuucagaaccuuaggcaacuuuagacaacuacuacugcc

SEQ ID NO: 2249119 - RNA, 77 nt, Homo sapiens
ucugccaccuuuaagauaauagcuguccuuacuagcuagguccggggaccugcagcccuauuuuggagaagugcgga

SEQ ID NO: 2249120 - RNA, 73 nt, Homo sapiens
aggcuggagugcaauggcgcgaucucggaucacugcaagcuccgccuccgggguucaugccauucuccugccu

SEQ ID NO: 2249121 - RNA, 71 nt, Homo sapiens
ggagagcuggcuuucuccugaucucaggccuggauacugcccgccagggugucgggagaagccaccuuucc

SEQ ID NO: 2249122 - RNA, 70 nt, Homo sapiens
guacuuuggguuaguuuuccaaucuuuggucuucuuuaaaggggagagagugggagauuuccagcagugc

SEQ ID NO: 2249123 - RNA, 67 nt, Homo sapiens
uggagacuucauuacacaggcaucauugauuaaaucauuggugauuagugaaugaacucaaacucca

SEQ ID NO: 2249124 - RNA, 91 nt, Homo sapiens
aggauugaaggauauaaauuuugggggccaagggacagagggcuaugguccaaauguuugugucccucuaaaauuuauauguagaaauccu

SEQ ID NO: 2249125 - RNA, 99 nt, Homo sapiens
ccaccagcaaugaaugagaguuccuguugcuccacauccuugccagcauuuguuguugucaguggucuggaugcagccauucucauagguguguugugg

SEQ ID NO: 2249126 - RNA, 82 nt, Homo sapiens
aacuagccagugugguagugcuuaccugcagucccagccacucaggaggcugaggugggaggauugccuaagcucgggaguu

SEQ ID NO: 2249127 - RNA, 88 nt, Homo sapiens
ggagaaaucgcuugaacccuggagguggaggugcagugagcugaaaucgcgccauugcacuccagccugggugacagagcgagacucc

SEQ ID NO: 2249128 - RNA, 84 nt, Homo sapiens
gugagcagacuuccuuggagaugaagcagaguugcugugaucuaauucauugacucaguuguuagucuucauuuacuuucucac

SEQ ID NO: 2249129 - RNA, 56 nt, Homo sapiens
ccauuuggcugccauaauccacaaagcuggcuuguuggaaugaauggccaacaugg

SEQ ID NO: 2249130 - RNA, 57 nt, Homo sapiens
ggguguauacauguguguucacgcaugugugcauguguguuugugguguguauaccu

SEQ ID NO: 2249131 - RNA, 83 nt, Homo sapiens
auuccauuuggucuaagagcauacuuguaugauuucuauucuuuuauauuuguugagguauguuuuaugguccauaauggagu

SEQ ID NO: 2249132 - RNA, 57 nt, Homo sapiens
gagcuaguguuuacuugccacucuuucgucccuccugugagcagugaacaccagcuc

SEQ ID NO: 2249133 - RNA, 62 nt, Homo sapiens
uugugaauagugcugcaauaaacauacgugugcaugugucuuuagagcagcaugauuuauaa

SEQ ID NO: 2249134 - RNA, 71 nt, Homo sapiens
gguggggauggaguuauacuauuauaagauuuuuaugcuuggagugguauaauauuauuuugaaauacacu

SEQ ID NO: 2249135 - RNA, 70 nt, Homo sapiens
gcaggcugagacucccaggcaugaguccauaggcaaaauuccucuuucaccagggaagucucaacucugc

SEQ ID NO: 2249136 - RNA, 61 nt, Homo sapiens
ggugauggcuuggcaauuaucacauugucucucuaaaagugauaaguuggcagccagcacc

SEQ ID NO: 2249137 - RNA, 65 nt, Homo sapiens
uuaaacugcagacucaguguucagaaugggaaaacuauaaaguucgagaacugagaugcguuuga

SEQ ID NO: 2249138 - RNA, 57 nt, Homo sapiens
ugcauggaucuuaaguauacaucuuggugaauucugauagauguauacauccaugua

SEQ ID NO: 2249139 - RNA, 101 nt, Homo sapiens
uugcaaggcccagcccaggcacaggccucagcacccaggcaggcucagagcacuugagguuggaggccuugccuggcuagaugcucagcuguggccuguga

SEQ ID NO: 2249140 - RNA, 74 nt, Homo sapiens
gagguccuucacaucccuuuaaguuggauuccuauguauuuuauucucuuugaagcaauugugaaugggaguuc

SEQ ID NO: 2249141 - RNA, 60 nt, Homo sapiens
gagaaugaugguuuccaguuucaucuaugucccuacaaaggacaugaacucaucauuuuu

SEQ ID NO: 2249142 - RNA, 85 nt, Homo sapiens
gagucuugcucggucccuaggcuggaguucaguguccugaucuuggcucacugcgaccucugccuaccggguucaagcaauucuc

SEQ ID NO: 2249143 - RNA, 85 nt, Homo sapiens
caggggcucugagauccuguuugcagguuuccuuuguacucugagguauaaucugucuagacaaggagucuugggcuagucucug

SEQ ID NO: 2249144 - RNA, 102 nt, Homo sapiens
aagggagacagagaaaggcuugcuuuuaaccauaucugagaccucgcuuucagaggccuuugugugggccaagggcuggccuacuuccuaguuuacucccuu

SEQ ID NO: 2249145 - RNA, 56 nt, Homo sapiens
ccucuggaaucuagaaaagguaaggaaacaaauccuucccugaagauuccagaagg

SEQ ID NO: 2249146 - RNA, 58 nt, Homo sapiens
gcacccuauugguucuaacccuaacucauacagauuuugguacuaaaaaguagggugu

SEQ ID NO: 2249147 - RNA, 75 nt, Homo sapiens
guuuuagacuauuuuguuuccuugucauuucaauggaauuuggaagagaagggagauaaacauauauguuuaggc

SEQ ID NO: 2249148 - RNA, 77 nt, Homo sapiens
gguuuuuuguccuugagauaguuugcugagaaugaugguuuccagcuucauccaugucucuacaaaggacaugaacu

SEQ ID NO: 2249149 - RNA, 90 nt, Homo sapiens
guuucacaguaggucugccccgggugaugcagccgucagucgggggccccugugugaagcggccgucauccggggaccccugugugaagc

SEQ ID NO: 2249150 - RNA, 124 nt, Homo sapiens
ggccucccaaaguguugggauuacaggugugagccacugcgcccagccuagagcaguaacuauuaagaaaccuuuaagccaggugcaguggcucacgcuuguaaucccagcacuuagggaggcc

SEQ ID NO: 2249151 - RNA, 93 nt, Homo sapiens
ugcauaaaauaacuuggauauucaagugaggauggcuaauccaaacaaugcuuagcauucucauuugcauaaagagcuuugaguucauaugca

SEQ ID NO: 2249152 - RNA, 114 nt, Homo sapiens
cagacauagaauguucgcugccuuucuaaugacauucacagaguuauuuuuaugcuuaaucaaaugagucucagacagcuuuugaauauggaaaggaugauacacaaauguuug

SEQ ID NO: 2249153 - RNA, 61 nt, Homo sapiens
gauuaagaggcagccauccacucugagaauagcucagaguggagucugcagccuuucaguu

SEQ ID NO: 2249154 - RNA, 122 nt, Homo sapiens
ucucacaguuuccauuugugaggaguuggggcaggcuuagcuaggucuuuggcucagggucccacaaggcuacaaucaaggcacuagcugagcugcauucucaucaaaggcuggacugggga

SEQ ID NO: 2249155 - RNA, 130 nt, Homo sapiens
acagaauuggcagcugggcacagagaaacaaguaagggcuuuggaguguucugguccgggcucugucauuuacuaauguagcccuugagcaaauacuuuaaaccccuugagcacugguuuccuuuucugu

SEQ ID NO: 2249156 - RNA, 60 nt, Homo sapiens
cucuuuguguucaggagccacguaccugggaacaaagggaugggccagggauacagagag

SEQ ID NO: 2249157 - RNA, 67 nt, Homo sapiens
gagucuugcagcauguaggcacguuauucaguaauaauuagugagugcuuaacauguggcuaggcuc

SEQ ID NO: 2249158 - RNA, 68 nt, Homo sapiens
agggauagaggaauaugugccaagcaaauagaaagcaaaaauaagcaggggauguaauccucaucucu

SEQ ID NO: 2249159 - RNA, 113 nt, Homo sapiens
gaugaguauaguuugaaucuaugaggauauucacuguuaaguaugaaguaaggcagucucauuguugagcaaacagcuuaacaguguccucaagaauucaggcucuuuccauc

SEQ ID NO: 2249160 - RNA, 99 nt, Homo sapiens
gaggcgggagaaucgcuugaacccagauggcagaguuugcagugagcccagaucgcgccauugcacuccagccugggugacagagcgagacuccaucuc

SEQ ID NO: 2249161 - RNA, 76 nt, Homo sapiens
agguugaaccauaugaaauggccaucuuuguagguuaaaagugguugacucuuggcaguuucauaugguucaaccu

SEQ ID NO: 2249162 - RNA, 63 nt, Homo sapiens
uuuauuuggcuuuugugauacguaauuguaguugaaauaauuauugcaucagaagccaauaaa

SEQ ID NO: 2249163 - RNA, 83 nt, Homo sapiens
uauggagugugugcaaagagcaguugagagugcuggccaagauauugaguaacagccuccgaugcuccacagaacauucugua

SEQ ID NO: 2249164 - RNA, 86 nt, Homo sapiens
agugcuuacguauagcagcagcuaguagugauaguacuuuccgugauuucauauuguuacaagugcaugcuguuuaugagggcacu

SEQ ID NO: 2249165 - RNA, 97 nt, Homo sapiens
uuacauuaucauuaacuguuucucuguaauauauuaaaccuuuuguucuuugucuuuacauaucugauauguuagggggagaaguuaacaaauguaa

SEQ ID NO: 2249166 - RNA, 86 nt, Homo sapiens
ucacuucacauggauuaacucauuuauuucaauggcuuuguuuuauucaugcccauuuuauagaugaggaaauucaggugcaguga

SEQ ID NO: 2249167 - RNA, 66 nt, Homo sapiens
guauuucuaguucuagaucccugaggaaucgccacacugacuuccacagugguugaacuaguuuac

SEQ ID NO: 2249168 - RNA, 103 nt, Homo sapiens
uugugaaaauaugacaaggcaaagcggcuuuggcuagguuaguuauuuggguagagaagugacuggauagauaaaguuaguuuaaccagguuuguuuguacag

SEQ ID NO: 2249169 - RNA, 126 nt, Homo sapiens
aaagaaagagaaaaaagaaaugauugaugguguuuuucagaggaccccagucccauuaucugccuuggaaaugggacugggguccuuugaaaaacaccuuuuaucauuucuuacguuuuuuuuuuu

SEQ ID NO: 2249170 - RNA, 56 nt, Homo sapiens
uuucagucacugggauuauggucaugagccaccaugucugaccugguguauuggga

SEQ ID NO: 2249171 - RNA, 57 nt, Homo sapiens
aaccuguuuaccauguguuuuggguaugguugucuuauacaguauugugcacagguu

SEQ ID NO: 2249172 - RNA, 63 nt, Homo sapiens
uuuauucuccuguaggagcaaguuccuaaggcaaggagguugcuccccucauggaugaauaaa

SEQ ID NO: 2249173 - RNA, 82 nt, Homo sapiens
guuaguuaaggguuacacagcuaguuagugguagacacaguuaagggucacacagcuagucaaugguagacaguuaaaagac

SEQ ID NO: 2249174 - RNA, 60 nt, Homo sapiens
auuaagagaagugugaaaaacaggauuuucaaagaaucuuggguuuguccuucuccuagu

SEQ ID NO: 2249175 - RNA, 78 nt, Homo sapiens
acauugaugggcauuuguguugguuccaagucuuugcuaauguguauagugcuggaauaaauauacgugugcaugugu

SEQ ID NO: 2249176 - RNA, 129 nt, Homo sapiens
uuaaauaccaaauacucuuuauaaaaacaacagaugagcuagaauauuuuguauaguguggcauuuucauugaaacuauggaguuagaaauucugcuuaugaguuuuuaguagaggcauugguguagcg

SEQ ID NO: 2249177 - RNA, 81 nt, Homo sapiens
auacaguagaaguccuuugugacauguauuuaggcuugagacuaauacuugucauaaaggcauuauaaguguuuauuguau

SEQ ID NO: 2249178 - RNA, 55 nt, Homo sapiens
uugagaugaagucuugcucucucacccaagauggagugcaauggcgugaucucag

SEQ ID NO: 2249179 - RNA, 81 nt, Homo sapiens
gaacucuccacauuggaaaggauccccccagaccagagaggcguaaggagggggcuggugcuuuccaguguugaacuguuc

SEQ ID NO: 2249180 - RNA, 56 nt, Homo sapiens
uggaagacauuuuggaccuugggauacugcacacuucauuuccauuuugucuuuua

SEQ ID NO: 2249181 - RNA, 76 nt, Homo sapiens
uccuucaguggaugauguuuucuguggucuuguucaggaauuuacaaacuagaggaagccuuaucucaccaaggga

SEQ ID NO: 2249182 - RNA, 101 nt, Homo sapiens
uucuguacauuuacucaguuucacccaaugguaauaucuuggaaaucuguagaauaauaucacaaccuggauauuaacauugaugaaauugagacacagaa

SEQ ID NO: 2249183 - RNA, 58 nt, Homo sapiens
gcuucuguggcucagggguguggacucacauucgccucugcaccccuaccucagaagc

SEQ ID NO: 2249184 - RNA, 79 nt, Homo sapiens
cuguaagaaguacauuucuguuguuuauaaauuaccuagucuaagggauuuugucauagcagcaggaauggacugacag

SEQ ID NO: 2249185 - RNA, 105 nt, Homo sapiens
uuuugcauggcuagauaugugcuggaugacuaagaauuuuauaauuggcauaucaauaaucaaaucaguuuuccuaauaaaaugacaugucugauuucugcaaaa

SEQ ID NO: 2249186 - RNA, 56 nt, Homo sapiens
uuaauuaaagcuacuuuaguguauaucaagugguaucucauugugguuuuaauugg

SEQ ID NO: 2249187 - RNA, 62 nt, Homo sapiens
gcuuggcagcacgcaguccagaggcucccggagccaggcccucugcggauguuugcugcggc

SEQ ID NO: 2249188 - RNA, 96 nt, Homo sapiens
gcuuuuacauugucauuugaaaugcuaauucguagcuaauuguugucauuuuacacuuaguucuauuugguauugucagaggaauuauuuaaaagu

SEQ ID NO: 2249189 - RNA, 70 nt, Homo sapiens
gauguauggcagguuugggguuuuuuaaaauaacagcuuuauugagacauaauucaccugcuguauaauc

SEQ ID NO: 2249190 - RNA, 59 nt, Homo sapiens
ugagacugagucuugcucugucgcccaaagcugaagugcaauggcaagaucucggcuca

SEQ ID NO: 2249191 - RNA, 100 nt, Homo sapiens
gggaaacguuuauuuuucuucaccauugucuauaauauuaaauguaagcauuuuuaaaauuuguuuguuugguuagaugggcaaguucaggaaguuuccc

SEQ ID NO: 2249192 - RNA, 61 nt, Homo sapiens
ggagaggagagaaagaggccaaaaauuuuuuugaauaauggccagaaacuucuuuucaucc

SEQ ID NO: 2249193 - RNA, 71 nt, Homo sapiens
ucuuuauagcagugugaaaauguacuaauacagagaauugguauugggauagugggguauugcuguaaaga

SEQ ID NO: 2249194 - RNA, 59 nt, Homo sapiens
acgggugaugucagcaaaacuucuugcuuagaaacauuguuuugaacuuggcaaccugu

SEQ ID NO: 2249195 - RNA, 109 nt, Homo sapiens
gaguuagguuguccaguuuguggcagcacauauagguuguuuuauuucuaccggcuucauuaauaauaaagcugccugcaaugcucucaaaaagauaaucgcuuagcuc

SEQ ID NO: 2249196 - RNA, 55 nt, Homo sapiens
agccaaagaguauuaggagcaaugaaaacguguagugacuggauacccuuuggcu

SEQ ID NO: 2249197 - RNA, 63 nt, Homo sapiens
auggcuagauuguaugguaguucuacuuuuaguuuuuaaagaaaccuccauacuguuuuccau

SEQ ID NO: 2249198 - RNA, 91 nt, Homo sapiens
cuuucucccaagaagcaaugcugauauaauagaaauugcuacaaaaugccaacacaaacaguaauucuguauguaucagaguuggagaaag

SEQ ID NO: 2249199 - RNA, 69 nt, Homo sapiens
guucugagcaaagaagugauaaugaauggacaaguuucaaagaaucauuuuggcugcugugcuaagaac

SEQ ID NO: 2249200 - RNA, 72 nt, Homo sapiens
uuugggaggccgagguaggaggaucacuugaggucagcaugaccuacauggugaaacugugccucuucuaaa

SEQ ID NO: 2249201 - RNA, 73 nt, Homo sapiens
auccaguuuuaggagauuucuaucugcauuacuccacucucacagugcuauaaagaaauauccgagacugggu

SEQ ID NO: 2249202 - RNA, 87 nt, Homo sapiens
aggaagacuuucaguuauuccccauucaauaugauauuagcugugggucugucauucauggcuuuuauuauguugagauaucuuccu

SEQ ID NO: 2249203 - RNA, 78 nt, Homo sapiens
guaggaguuugaggucuucaugaguugcccgauucaugcucccaugcugguauuuggugaugccuccaaacuauuuac

SEQ ID NO: 2249204 - RNA, 64 nt, Homo sapiens
guaucuauuaaaaguuuuugcuuugugguuaccacaaggcaugcaaagaacauuuuaugguuac

SEQ ID NO: 2249205 - RNA, 69 nt, Homo sapiens
agcaauucucuucaggaaaaugucauacgugguagaaauucaaugcauauuuuaccuagaagagcggcu

SEQ ID NO: 2249206 - RNA, 56 nt, Homo sapiens
uaaauuuccauuguugauaagccacccagucuaugguagcuuguugugguaguuug

SEQ ID NO: 2249207 - RNA, 63 nt, Homo sapiens
cugccaacggggcacggugcgugggaugccaagcugacaucacuaugcaggugucucgggcag

SEQ ID NO: 2249208 - RNA, 70 nt, Homo sapiens
guuggugcaaaaguaauugugguuuuugucauuggaaguaaugguacacugcaauuacguuugcaccaac

SEQ ID NO: 2249209 - RNA, 85 nt, Homo sapiens
cagacuacugauuugggcuacaaauaacacugccugguuuuuuguagccagguaguguuauuugcagcugaaaucaguaaguuug

SEQ ID NO: 2249210 - RNA, 71 nt, Homo sapiens
ugauaauugcagacgugguaguacaguauuuuaagucaauccccaugucuugaaugccacuuguuuuauca

SEQ ID NO: 2249211 - RNA, 64 nt, Homo sapiens
uuccugguuucucuaauuguauuaugguucuguagcaugauaacauugggggaagcugagugaa

SEQ ID NO: 2249212 - RNA, 68 nt, Homo sapiens
uaggacuuugagaauuguuauuaggugaguuugacaauagcacaggguaauaaugucucagacaccua

SEQ ID NO: 2249213 - RNA, 73 nt, Homo sapiens
ucccagggaucgcuggugucuaagcgacagcuccuugguggacugugguuuaggaaaucgggggagggcggga

SEQ ID NO: 2249214 - RNA, 55 nt, Homo sapiens
ggcagcaucaagauccagcaggaaagaguucugugaucaauuagugaugucugcu

SEQ ID NO: 2249215 - RNA, 55 nt, Homo sapiens
ugagauggguaauuaaauggugaauguauucacauguuuucaauugcugaucuca

SEQ ID NO: 2249216 - RNA, 70 nt, Homo sapiens
ggguaaacuccuaaaacaguaucuugacuuaaaaacauucaguuguauacucuauuuuagcagugagccc

SEQ ID NO: 2249217 - RNA, 107 nt, Homo sapiens
ucuaguuauagucuaacaaaaagagcugagagguauucuuaagccaaauauuguggggaaaugguuaaaaaaaacuucucagcucuuuuuguuugacuauaaguaga

SEQ ID NO: 2249218 - RNA, 68 nt, Homo sapiens
agcaaguguguucauauauucauugucuggaauaguaccacagacuagacagaugaacagcacauguu

SEQ ID NO: 2249219 - RNA, 107 nt, Homo sapiens
ucaugugauugguccugcacaucucuucuggccaggcagacuacguuucuggcuacccaugacuuagaauuuuugccugcuaggugaggacagggcccaucacaugg

SEQ ID NO: 2249220 - RNA, 60 nt, Homo sapiens
guacuaccuguaagauauacuguguauaagcaguauacacaguaagcacaguguagauac

SEQ ID NO: 2249221 - RNA, 82 nt, Homo sapiens
gucuuugucugcuguguuugagaucugugcuuuugcguuggcgagccccagcacaaggguaguuucagugauuugcaaggac

SEQ ID NO: 2249222 - RNA, 97 nt, Homo sapiens
augcaaaggucuauguagggcuuaucuguguagaguucuguuccacucugugugugugugagcucuauaggauggguugcacauggucuagauguau

SEQ ID NO: 2249223 - RNA, 80 nt, Homo sapiens
gucuuauaggugguauuuaaaauuauuuggcucuuucaaauaaaaaggggagugaauaaucuuggguauuaauaaaaggc

SEQ ID NO: 2249224 - RNA, 113 nt, Homo sapiens
aacuuacaguuuacuuuggcuuuccaauaaggcuaggaauucucugaagucauauagagcuuauucuucacagagucccugauuguuggcagaauugcugaacaauguaaguu

SEQ ID NO: 2249225 - RNA, 89 nt, Homo sapiens
uuaggguuuaguuuauucagauuuucuuuguaucugagaccagcuuucaucagaaugcauggcagagucaggguacacugcagcucuga

SEQ ID NO: 2249226 - RNA, 59 nt, Homo sapiens
guggguaaaucuguuuggggcucucagcucugaaggcugugaguucucugauuucccac

SEQ ID NO: 2249227 - RNA, 72 nt, Homo sapiens
gcugcauaggaucuguguggacacuucagucuucucucccacuugcuggccccuccccgggucuagugcagc

SEQ ID NO: 2249228 - RNA, 75 nt, Homo sapiens
acccuaucucugcaguggucucacuggcaaaguacccauaucuuugcagugguuucacuggcaaauaauuagggu

SEQ ID NO: 2249229 - RNA, 59 nt, Homo sapiens
ugugccaaucauagggcuugguuuauuaauuuucacaaccuaccugagcaauuggcaua

SEQ ID NO: 2249230 - RNA, 98 nt, Homo sapiens
uugccuuuuacuuauauuucuaaagcaucacuuuuccuacuuuuagagcauuguauugaagguagauaagaacaaggaugcuauugagugcuagguaa

SEQ ID NO: 2249231 - RNA, 79 nt, Homo sapiens
uuccaacacuauguugguucuguuuauaugcuggauuacauuuauugauuugcacauguugaaccagcaaaaacuggaa

SEQ ID NO: 2249232 - RNA, 80 nt, Homo sapiens
aaaguuccauguuggacuaaagaaacauuccgugagaguuuuucguguucucagugguccauuuugcauggguuggcuuu

SEQ ID NO: 2249233 - RNA, 64 nt, Homo sapiens
uucaguuugccaguauuuuacugaggauuuucucaucgauguucaucagggauauuggccugaa

SEQ ID NO: 2249234 - RNA, 77 nt, Homo sapiens
ggccauguuuaugugcuugcaaagcuuggcugcggggagagaucccaggcacgcuugggagacacacugcauuugcc

SEQ ID NO: 2249235 - RNA, 67 nt, Homo sapiens
aagcuagaugaaacaucuuuggaaacugaaaguauacuuacagauuaaguauguugucaacuaguuu

SEQ ID NO: 2249236 - RNA, 58 nt, Homo sapiens
aauguaugagaguuccagcugauguguagccuaaccaguacugauauucucauauauu

SEQ ID NO: 2249237 - RNA, 70 nt, Homo sapiens
aauaccucaacugcuguagaugaaggggcagcauuugcucuagauccucaucacagcauuuccugguauu

SEQ ID NO: 2249238 - RNA, 68 nt, Homo sapiens
guagggguaaauucuggacuuugccauugcauuuguaaaugucauggcacugaugagaguuuccuuac

SEQ ID NO: 2249239 - RNA, 61 nt, Homo sapiens
ugugaacagcuccaaauguggaccucuucucucccaaaugacaaacacauggacugucaca

SEQ ID NO: 2249240 - RNA, 56 nt, Homo sapiens
accaaugggaaggugcucugcacaugaccaaguauacagugcacuuucccacuggu

SEQ ID NO: 2249241 - RNA, 63 nt, Homo sapiens
uggagagcaugugcuggcaucaguagagaaaauuugauacuuuaacaugcauuauguuuuuca

SEQ ID NO: 2249242 - RNA, 126 nt, Homo sapiens
gaugguauuuucucaugacuaccuccagcaaagacuuauggaaggcuugugauaccucagcuuggauuacaugucuauccaugaacaauuauuguggacaaggacauagauuuucugaguaccauc

SEQ ID NO: 2249243 - RNA, 95 nt, Homo sapiens
cccuacuauuuucuugggaaacauccagcacauacucaaggugggagggcaguaagcuugaugguggcuagauguuucugaagacaagaguaggg

SEQ ID NO: 2249244 - RNA, 74 nt, Homo sapiens
ucucguaaguugguuuccuguaacuggacauaugcaaaaguaugcuaguuucaaauaaccaaaaguaaaugaga

SEQ ID NO: 2249245 - RNA, 55 nt, Homo sapiens
cagacagcucagguagaaccaaaguagcccuuggguuuuggcuuaaagcagucug

SEQ ID NO: 2249246 - RNA, 75 nt, Homo sapiens
acacagacuaaaugguaaccagaugaggugauggauguauuaauucgcuugauagugguaaucauuuuucgaugu

SEQ ID NO: 2249247 - RNA, 66 nt, Homo sapiens
ugaauucuguuagaagguaguucagcacacccucauuuauggacugaaaugccuuuaaugaauuua

SEQ ID NO: 2249248 - RNA, 62 nt, Homo sapiens
ccuucauacaaagaaaaaucaggugagcgaucacaguaccugguuuuaacauuguauuaagg

SEQ ID NO: 2249249 - RNA, 79 nt, Homo sapiens
gcaguucgcuucaagguuauaucuuaaaauccaagagaaaggggaaaaaaaguuaagaugcauuuugaaguuaagcugc

SEQ ID NO: 2249250 - RNA, 95 nt, Homo sapiens
gaauucauaggaguuugggauucauaucaagucuuagaguuuaagugucauaagcugauggucuuguaugaugucauuacuccuauuauguauuc

SEQ ID NO: 2249251 - RNA, 68 nt, Homo sapiens
guuccauauuauacaagcuaaaauggaagaucaagucuggucuuucuuguuagguugcauguuggagc

SEQ ID NO: 2249252 - RNA, 77 nt, Homo sapiens
gaaugugaaggccuaggacauuacuguauacuucuguggacuuuagaaacacuguccaguuaggcuacauugcauuu

SEQ ID NO: 2249253 - RNA, 83 nt, Homo sapiens
gaugcucuucaguaggugaauggauaaacugugggucauccagacaauggauauuauucaucacuaaaaagaaaugagcuauc

SEQ ID NO: 2249254 - RNA, 55 nt, Homo sapiens
gggagccuauagagaggaggucauauacuaguugauuuuggacuaaaggcauccc

SEQ ID NO: 2249255 - RNA, 62 nt, Homo sapiens
ucucucuuccugccuugcugauaacugucuucuuugcugugucuucacauggccgagagaga

SEQ ID NO: 2249256 - RNA, 79 nt, Homo sapiens
uucgagaauguaaaccgugcacucccaggaaaaugcagacacagcacgccucuuugggaccgcgguuuauacuuucgaa

SEQ ID NO: 2249257 - RNA, 86 nt, Homo sapiens
gacagggaugcuguuuggagcuucuggcaugcccccauaggugaaucacaauggaggccuacagaauuuuggagcaaggcccuguc

SEQ ID NO: 2249258 - RNA, 72 nt, Homo sapiens
augauuaaguaaugguuccaauaauauaaccgcaguagcaaccaguguaguaucaggaaccgugcuaaucau

SEQ ID NO: 2249259 - RNA, 64 nt, Homo sapiens
ccagauggucaccuucuugcucugucuucacaggguagagagagagagagagagggaucuuugg

SEQ ID NO: 2249260 - RNA, 67 nt, Homo sapiens
gcuuuucucccucuaccaacagucaggccaggagaguuuugggaaaugaaguugguagauaaaaggc

SEQ ID NO: 2249261 - RNA, 60 nt, Homo sapiens
caccuggcuauucccucaaucugggcccuggggccauggcaauguggaaugguccaggug

SEQ ID NO: 2249262 - RNA, 70 nt, Homo sapiens
acuguagagguagauucuguuuugacccuuugaggauggagaagucaguuuacggacuacacucagcagu

SEQ ID NO: 2249263 - RNA, 62 nt, Homo sapiens
cucuucugggucaaaacgaaagcucagcuacagugagagcuccuuugcuuuuuccaggagag

SEQ ID NO: 2249264 - RNA, 93 nt, Homo sapiens
uaggggaauugcuugaacccgggaggcggagguugcagugagcagagaucgcuccacugcacuccagccuccugacaacagagcaagacucug

SEQ ID NO: 2249265 - RNA, 83 nt, Homo sapiens
uauuagguuggugccaaaguaauugcuguuuugccauuaaaaauaauugcaaaaacugcaauuacuuuggcaccaaccuaaua

SEQ ID NO: 2249266 - RNA, 78 nt, Homo sapiens
caauguuaauacugagaugugagguacuaucccagccaucauguugauuguuaccuggauauuuuguguucuccauug

SEQ ID NO: 2249267 - RNA, 78 nt, Homo sapiens
gggauauuaaaacugguauugaauuuaggaagauagugccuauguaacuuucccuucagaacucaguuugcaaaucuc

SEQ ID NO: 2249268 - RNA, 107 nt, Homo sapiens
gcagaugucuacaacuccaaggacacaugcauuggucuauuaugugaaaaaguaauccauuucuauuacauuaagccaauggauucuugaguuugauuuauuacugc

SEQ ID NO: 2249269 - RNA, 64 nt, Homo sapiens
cgagccuauggguguuauugcaugggagaugggucucuugaagacaacauaccauuuggucuug

SEQ ID NO: 2249270 - RNA, 58 nt, Homo sapiens
ugggacuaggucaccaagaugacagauugguaacaaggucuuaggugaccaguuccca

SEQ ID NO: 2249271 - RNA, 81 nt, Homo sapiens
uuugcaaaggaccauuguguagcagacauaagguguucacuauaauuguuccggaugucagcuuuacaauucguuucuaaa

SEQ ID NO: 2249272 - RNA, 64 nt, Homo sapiens
uucaguuugccaguauuuuacugaggauuuucacauugauguucaucagggauauuggccugaa

SEQ ID NO: 2249273 - RNA, 130 nt, Homo sapiens
ggagacagucucucucuguucccaugcuggagugcaguggcacgaucucagcucacugcaaccuccgccucccuagacaagaucgugccacugcacuccagccugggcaacagagcaagacucuaucucc

SEQ ID NO: 2249274 - RNA, 130 nt, Homo sapiens
uuuauucuugcuccuacugagaaauaaauacugacuauaguuuucuugacacaguuuagauacuacugaaaauguguuuguggagaaaauuagagcauuuguauuuagguucaugcuuuggugagaaaag

SEQ ID NO: 2249275 - RNA, 65 nt, Homo sapiens
uuuguuuacuacucucuaugaccaguuuugugcuaggacugguagaguugaguaguugccacaga

SEQ ID NO: 2249276 - RNA, 77 nt, Homo sapiens
aaggugacaucagcuccagguauaaaaggauuacggcauagcaagaaaucagcuuagaucuggcaagauguuaccuu

SEQ ID NO: 2249277 - RNA, 88 nt, Homo sapiens
cucggccucccaaagugcugggauuacaggcgugagccaccgcgcccggccucacagccuaguuuuauacauuuuagggagauaugag

SEQ ID NO: 2249278 - RNA, 78 nt, Homo sapiens
guugugugcauauuuauucauauuuuuguuaaauguuaaaucauuuaucacaguaaaucugggugcauaguacauaau

SEQ ID NO: 2249279 - RNA, 57 nt, Homo sapiens
ucugugugacacacaaaguaugcaucacacauaccuacauuuuugugugugacgaga

SEQ ID NO: 2249280 - RNA, 72 nt, Homo sapiens
uaauauucacagggggagaaggguauaauacucccgauaucgcaggggguguacacucccccugugaaguug

SEQ ID NO: 2249281 - RNA, 59 nt, Homo sapiens
gggaacugcauuguucagacuccugugccagcaggguuccugauacgguugcaguucuc

SEQ ID NO: 2249282 - RNA, 94 nt, Homo sapiens
ugcacauuuaaaagugaguaggugggaauccaaagaauaacauauugauaugguuaggcuuuguguccccacccaaaucucaucuugaauugua

SEQ ID NO: 2249283 - RNA, 64 nt, Homo sapiens
aacguauguauuuggaggggaugcaaacacucagaccauagcauuccucaaguacuaauauguu

SEQ ID NO: 2249284 - RNA, 83 nt, Homo sapiens
ugggcuaauaaauagagauaucaauuucauggugaucgucacugaucuuuacuuuaaaaacugauaauucauuuuuugguuca

SEQ ID NO: 2249285 - RNA, 74 nt, Homo sapiens
aagcuucaggagaugaagugucaauaaggauuaauacgaagguagaucaaucacgcugucauuucauagggcuu

SEQ ID NO: 2249286 - RNA, 100 nt, Homo sapiens
acucuuuucuugcuuggucuuugugcuuuuuaaauagcuuccuuacaaagaaagaaagacuaaaggaaagagcagggaaagaaagcuaaagaagcagagu

SEQ ID NO: 2249287 - RNA, 69 nt, Homo sapiens
gugggaaaaugucuauugaaugaagaugucaccugaaaccaguccucuuuauaaaguuagauaucucac

SEQ ID NO: 2249288 - RNA, 67 nt, Homo sapiens
ugccuaggggugccugcaguuucugcaccacacauucugguccaguguuccucagucaccccaggca

SEQ ID NO: 2249289 - RNA, 77 nt, Homo sapiens
caaguagauuuuuuauauggucaauauuguuuccauuucuaagggcauaauagcugaucauuuagaaguaucacuug

SEQ ID NO: 2249290 - RNA, 130 nt, Homo sapiens
ugggaucugcacuaaagaggcacaugugaaccucaguuaagaaauacuugggguuaaaauaaggauaucacuaggucccguuucagacugagaauuagcuacaagucaggcccuuggaggauagaaccug

SEQ ID NO: 2249291 - RNA, 70 nt, Homo sapiens
uaagucuggagguacaggaaauaaggaauucuuuuagggcugcuauagaaguuuuguacucugugacuug

SEQ ID NO: 2249292 - RNA, 68 nt, Homo sapiens
caguugagauuauuagauguucugcuugaagcaucuuuggcuaaagugagagcagauagugacgauug

SEQ ID NO: 2249293 - RNA, 61 nt, Homo sapiens
ggagguagucuuucccuuaucagagcucaaacacugugcugggggaacccaagauuccuuu

SEQ ID NO: 2249294 - RNA, 90 nt, Homo sapiens
cacuuuugcaaaagaugcagaaauguuuuucaugugggcaacccaccuggaguugauucacgaagagccauuuaacauucugcagaggug

SEQ ID NO: 2249295 - RNA, 74 nt, Homo sapiens
guuccacagggccucuggauggugagauaaagaaaagguguuuccuuuuuuccuuccacugucccuccaggaac

SEQ ID NO: 2249296 - RNA, 74 nt, Homo sapiens
ucauguagugugauuuucacuagaaggucaauguaauaccaccuucaagucugcgugaaagaugcauugcauga

SEQ ID NO: 2249297 - RNA, 105 nt, Homo sapiens
auuccuaaguauuuauuuuuugugacuauuguaaaugggauuguucucuugaauauuuuuuucuagaaagcucauuacuaguguacagaaaugcuacuuuugagu

SEQ ID NO: 2249298 - RNA, 93 nt, Homo sapiens
aaguagauaggcgguuuaguuugguuuuuguuaucacucaugucauuuagcagcaagaguggcuaggaccaggaaaauaugccauuuuagcuu

SEQ ID NO: 2249299 - RNA, 118 nt, Homo sapiens
ucagaucagcagcggcauuagauucuuauaggagcgggaacccuauugugaacuccacaugugagagcuccagguuucaugcucuuuauuagaaucuaaguaaugccuguugaucuga

SEQ ID NO: 2249300 - RNA, 71 nt, Homo sapiens
ggugauggauauaucuauuacauugaccauggugacaguuucacaaguguauagacauguccaaucucauc

SEQ ID NO: 2249301 - RNA, 67 nt, Homo sapiens
augccuauguccugaaugguauugccuaggauuucuucuaggguuuuuaugguuuuagguauagcau

SEQ ID NO: 2249302 - RNA, 65 nt, Homo sapiens
aaagccucuucccagagaaaaggguuucuuuugcuaagggaauuaaccucuggggacagcguuuu

SEQ ID NO: 2249303 - RNA, 73 nt, Homo sapiens
gggaauucuuaugcacuguuguugugaauguaaacuauuucagccacuguggaaagcaguguggagauuucuc

SEQ ID NO: 2249304 - RNA, 73 nt, Homo sapiens
aauguacuuauuugauuuaauaauaaccaggauauugaugucuuuggugagggauaaauuucauugguacauu

SEQ ID NO: 2249305 - RNA, 98 nt, Homo sapiens
aagguaaacaaaugaggugauggauaugucuauuagcuugauugugguaaucauuucacaacauaaagguuauaucaaaaccucacuuuaaauaccuu

SEQ ID NO: 2249306 - RNA, 94 nt, Homo sapiens
aaggggccccuuucuuucauaccuguuaaaauggcuauuauaaaaaaagauggaagacaaguguuagcauggcuguggagaaaagggaacccuu

SEQ ID NO: 2249307 - RNA, 68 nt, Homo sapiens
auauuauugagagagaacauuuguuacaggggcaaacccuguuccaagguuucuuucacucaaaguau

SEQ ID NO: 2249308 - RNA, 121 nt, Homo sapiens
guaaaauagaagaaacaaguuucuaagagaccaagaugcuacauucuacaauuaggcuaauuuguuuuagacuuguccuggaaugaggcauuuguuaaaggaaaauaugucuuacccuuac

SEQ ID NO: 2249309 - RNA, 67 nt, Homo sapiens
gaucugucagugggauguugaagucacccacuauuauuguauggcugucuaucucauuucuuagguc

SEQ ID NO: 2249310 - RNA, 57 nt, Homo sapiens
uaggaggccaagccaucucuggagaugacuaucucccaguguguagcuugucucuua

SEQ ID NO: 2249311 - RNA, 86 nt, Homo sapiens
uccaauugucuagauucuagaaaguuaaucagaucuuuuauguucuaacauuuuaugaucaucugaaagcuuuuacagacaaugga

SEQ ID NO: 2249312 - RNA, 66 nt, Homo sapiens
gcugcagaucuucgcgguaaguguuacagcucauaaaagcagcguggacccagagugaucaguagc

SEQ ID NO: 2249313 - RNA, 88 nt, Homo sapiens
ggagaauggcaugaacccuggaggcggagcuugcagugagcugagauagcgccacugcacuccagccugggcaacagagccagacucc

SEQ ID NO: 2249314 - RNA, 73 nt, Homo sapiens
cuucacauauaaauacaacauguguuaaaggacuaaauuucuagugucacaguuuguacuuuauaguuugaag

SEQ ID NO: 2249315 - RNA, 56 nt, Homo sapiens
auagcagaagaagggacaauucacauucucuuguagggauguccaucuucuccugu

SEQ ID NO: 2249316 - RNA, 61 nt, Homo sapiens
gcaacuaugugaggugaugacuacguuaauuagcuugacuauaguaaucacuucacaaugc

SEQ ID NO: 2249317 - RNA, 71 nt, Homo sapiens
uguagagguuaacaucuacacuugaucuuagccaaaaggcugagaagugauauagaaguuaacaucuaaca

SEQ ID NO: 2249318 - RNA, 73 nt, Homo sapiens
gggaauuaaguuaggcuucagcagucugagccuuggugugggcggagacauacaugaucuuaauuuauaucuu

SEQ ID NO: 2249319 - RNA, 68 nt, Homo sapiens
guguguguguguacaugugugcaagugcaugucaauguacacauaugugcacauuuacauauauacac

SEQ ID NO: 2249320 - RNA, 78 nt, Homo sapiens
cgcaugcauuagguauuuguccuaaauauucuuuaggaaaaagauauuuagaggcuaaaaucuugucuuguauuugug

SEQ ID NO: 2249321 - RNA, 88 nt, Homo sapiens
gugagguacaggaugagauuuugguagggacacagagccaaacuauaucauucugccccuggcccccucccaaaucucauaucuucac

SEQ ID NO: 2249322 - RNA, 56 nt, Homo sapiens
gugauuucuccagugauucuuugcuuaacgacagagauacauucugagaagugcac

SEQ ID NO: 2249323 - RNA, 116 nt, Homo sapiens
caaugucaucuuugugugauaucagaugagaugaugugagauacugcccaugcaaaugcuucaaaaaaggcagggcauuguacaaaucaucauugcuauuaauacagucuccauug

SEQ ID NO: 2249324 - RNA, 78 nt, Homo sapiens
cacaugacuagugccuacugaauuuaccuggcuuucgauucucagaaggcaggguggcuugggcugggagggucagug

SEQ ID NO: 2249325 - RNA, 98 nt, Homo sapiens
ggcaggagaaucgcuugaacccgggaggcagagguugcggugagccaagauagcgccauugcacuccggccuggguaacaaaagcgaaacuccauguc

SEQ ID NO: 2249326 - RNA, 70 nt, Homo sapiens
agguaccagcagaaucagugucuggugagggcuuccugguucacagucggugacuucuugcugcgugcuu

SEQ ID NO: 2249327 - RNA, 85 nt, Homo sapiens
ucucacuguuuuaauaguguaagaacuuugaaaucuacauguaauguaaugcauuaggucuccuuuuugccuaaauaaugugaga

SEQ ID NO: 2249328 - RNA, 68 nt, Homo sapiens
ucgcuugaaccugggaggcagagguugcaguuagccaaaauugcaccacugcaccccagucuggguga

SEQ ID NO: 2249329 - RNA, 75 nt, Homo sapiens
auaauuuggggaagauucugucuauaucaauaucucuauaaguauugcuauagcuauaucaucuccuagaauugu

SEQ ID NO: 2249330 - RNA, 59 nt, Homo sapiens
gugggaugaucacaguucacuguaaccucaacuuccugagcucaagugaucccucccgc

SEQ ID NO: 2249331 - RNA, 58 nt, Homo sapiens
ucuaagcugaccacauggccaagccaugugucaugauguggaguuguggcaguuugga

SEQ ID NO: 2249332 - RNA, 72 nt, Homo sapiens
uauuuaugauauggguugucaguuguaggacacagaguauuacaaucugggauucagcccauuuuucagaua

SEQ ID NO: 2249333 - RNA, 59 nt, Homo sapiens
cccugaccccuguagcagcauucuuaaaugggcuuaggucuaguuggagggguacaggg

SEQ ID NO: 2249334 - RNA, 78 nt, Homo sapiens
agcaaugauggcuuucaggacguggcgagccuggcgucucuuccauugucuuccucuccacuuuuggccauuucuguu

SEQ ID NO: 2249335 - RNA, 129 nt, Homo sapiens
uuggccucccaaagugcuaggauuacaggugugagccaccaggcccgacccaaggagaauauaguaagaacccauaaugggccuggcacgguggcucacaccuguaaccccagcacuuugggacuccga

SEQ ID NO: 2249336 - RNA, 110 nt, Homo sapiens
ggggcaaucaguucaauauguuuguaccauugaugugaagaugggacucgugucucuuugcugaucugucacauccaagaaggugcagacugaaagccacugaaugcuuc

SEQ ID NO: 2249337 - RNA, 70 nt, Homo sapiens
ugaaugcauggggccaagaagggaagaugucacagaaaaaauuccuucauuuggugacucaauguauuca

SEQ ID NO: 2249338 - RNA, 78 nt, Homo sapiens
guguguccucagcaaguuacuuagcuuggcuagaguuuuaucucugaguuaguguggugcuuggaaugcaggaugcac

SEQ ID NO: 2249339 - RNA, 66 nt, Homo sapiens
guuacuaugagacgaaugcaucaguccaucuuaucuugaugcugcugaacauuugauucauguaac

SEQ ID NO: 2249340 - RNA, 88 nt, Homo sapiens
caaaacaucuccuggauucauggauuuuuugaaggguuuuucaugucucuaucuccuucaguucugcucugaucuuagguguuucuug

SEQ ID NO: 2249341 - RNA, 130 nt, Homo sapiens
uucccaaagugcggagauuacaggugugagccaucgugucuggcccugaaugcuguuauuauucccuuaaaaaaguuucaguacuggccaggccugguagaucacuccuguaaucccagcacuuugggag

SEQ ID NO: 2249342 - RNA, 75 nt, Homo sapiens
ggcacacuguaggugcugaacucauugcugaaugcacacauccagcagauguuuagugagcgccuacugugugcc

SEQ ID NO: 2249343 - RNA, 67 nt, Homo sapiens
aguugagauaucuuggccuuugcaugacgucaacuacaaguggugcugggagcuuggugucacagcu

SEQ ID NO: 2249344 - RNA, 83 nt, Homo sapiens
auguugcaguuuaauuauccuauugaaaauguguuaaacgcucccaaguacaucaugaauaaggauuauuaaauuugcagcau

SEQ ID NO: 2249345 - RNA, 71 nt, Homo sapiens
aaggucugcuagcuuguagugauuugugguaaaucacaauuuucaugauccauuuacaaaaugguaaucuu

SEQ ID NO: 2249346 - RNA, 71 nt, Homo sapiens
ggcccaauuuuuuuccuguccaauacuuuuauagcagagaugauagaauguaacaguuaaaagcaugggcu

SEQ ID NO: 2249347 - RNA, 75 nt, Homo sapiens
agcucugcaaaucaagcuugacuccuuaaaggggagcauacccuuccagucaaagccuugguaaagcaaccaguu

SEQ ID NO: 2249348 - RNA, 129 nt, Homo sapiens
uagaaucccgcauguuccuggacagaaaggguucaccaaacucaguccauguguagucaccaaacacaguaccauauguuuggugaguagcuuucuguuuauuuauuuuagggacaaggucuugcucug

SEQ ID NO: 2249349 - RNA, 90 nt, Homo sapiens
uguugcuacuuauacugacuaaugaaagagugugauauguaaaccacauauauaauaccacguguauuagcuagcuauugguguguaaca

SEQ ID NO: 2249350 - RNA, 71 nt, Homo sapiens
acauauguuacaaacccauauuauauuguuauuauuuuaguguaaaaaguugauaugguuuggauaugugu

SEQ ID NO: 2249351 - RNA, 64 nt, Homo sapiens
acuuauucuagguauucauuuucuucccaacuauguagaagcauuuugagauacuagaauaggu

SEQ ID NO: 2249352 - RNA, 59 nt, Homo sapiens
gaucuggucuuugauuagacacccugaccuuuuacgaguguugaucauugaucaugauc

SEQ ID NO: 2249353 - RNA, 68 nt, Homo sapiens
auauuuugauuuacuuccaugucucauaauauugugccagagucagguuggaaaguaagucaugauau

SEQ ID NO: 2249354 - RNA, 79 nt, Homo sapiens
cagcugucaacaccucugggccucugguccauucucccuguuaagaaagagaaaauggcaagagccacagaggcggcug

SEQ ID NO: 2249355 - RNA, 70 nt, Homo sapiens
uuuuacccagcuccuauucgagaugcaguugcucugccguaacugccucugacauaggcaggaaguaaaa

SEQ ID NO: 2249356 - RNA, 75 nt, Homo sapiens
cuggauucaauuugccaguauuuuauugaggauuuucauauugauguucaucagggauauuggcccgaauuucag

SEQ ID NO: 2249357 - RNA, 109 nt, Homo sapiens
gcauagaaguuaaaugacuuguucaaggucacauugcuagcauggguuagagccaggauucaaccuaaggcagugugacugcagaguccaugcucuuuaaccacuaugu

SEQ ID NO: 2249358 - RNA, 56 nt, Homo sapiens
ggcuguuuuuggaaggugucuaauggaaaaaaguugaauacuucaaaaaaauagcu

SEQ ID NO: 2249359 - RNA, 70 nt, Homo sapiens
aucagagguacuuucauuuuucaauugccacacagacaaaggagggguugaaaagucaguagccucugau

SEQ ID NO: 2249360 - RNA, 130 nt, Homo sapiens
uauauguacguauacacgugcguauauguacguguacacgugcguauauguacguauacacgugcguauauguacguauaugcacguauauguacguauauguacauauaugcacguauauguacauaua

SEQ ID NO: 2249361 - RNA, 69 nt, Homo sapiens
ggaagugaauaguaauguguuuggucuccaaggugaaaagucaacagacuccacauuacuguaauuuuc

SEQ ID NO: 2249362 - RNA, 85 nt, Homo sapiens
caugaacggauguuggauucuauugaaggcuuuuuccacauguauugagauaaucauauggucuuuguuucuaauucuguuuaug

SEQ ID NO: 2249363 - RNA, 98 nt, Homo sapiens
cacauucaagucauagcagucacuaagauugucuuaguguguuggugaguucggccacacgugaagcaucuuuacccaucugcugugguuugaaugug

SEQ ID NO: 2249364 - RNA, 75 nt, Homo sapiens
gcuccccuaucacuguaaguuuacacuuuguagcuaauuuagcuacaaaguguaaacuuacagugacaggagagu

SEQ ID NO: 2249365 - RNA, 71 nt, Homo sapiens
uauggcuuuucacuuaaguccucuacugcucauuuggcauggacaggcuagaacucaaguagaaagccaua

SEQ ID NO: 2249366 - RNA, 66 nt, Homo sapiens
ccgcaaaggaaaauggagauauuuuaccuauuccugugauaacaguaucucaguuuuccuuugugg

SEQ ID NO: 2249367 - RNA, 63 nt, Homo sapiens
gugcugguguggucuagccgcuugcggccugagcugcagguggaagccugccacguccagugc

SEQ ID NO: 2249368 - RNA, 69 nt, Homo sapiens
ucacauguucucauuuauuugugggagcuccaauaguggaucucauggagguagagaguaaagugguga

SEQ ID NO: 2249369 - RNA, 57 nt, Homo sapiens
guuaucgucucacaguagaaacuggucuacucaucacagcuucuugaggacgaugac

SEQ ID NO: 2249370 - RNA, 87 nt, Homo sapiens
cgaggcaaugguaaguaucaggaauaguuauuggcgaguccagcacagcagucaaugacuguguucuggacugcaccguuggacucg

SEQ ID NO: 2249371 - RNA, 59 nt, Homo sapiens
gaaaaaugugagccuacuauaauaguauagccuacuguaauaguaggcucacauuuguc

SEQ ID NO: 2249372 - RNA, 86 nt, Homo sapiens
aggccauuuucacuucuuuugugauucuucaguuacuucaggccaucuggauguauaugugcaggucacaggggauacgauggcuu

SEQ ID NO: 2249373 - RNA, 81 nt, Homo sapiens
ggauaucacuaguuugguuuacucuggggauaucugaaaaaucucuggaagacuuagaguagcaucaguuguaggucaucu

SEQ ID NO: 2249374 - RNA, 63 nt, Homo sapiens
caagugaaugaugugaaguguaaaccaaccauuguuguguuucauguuacugucauacacuug

SEQ ID NO: 2249375 - RNA, 130 nt, Homo sapiens
guguauauguagauacacauauacacguguauauguguaucuacacauacacguguauauguguaucuacacauacacguguauauguguaucuacacauacacguguauauguguaucuacacauacac

SEQ ID NO: 2249376 - RNA, 65 nt, Homo sapiens
acauaaaaccuuuaaguuguuuugaaaagcugaauguugcaggagagcuaggcagagguuugugu

SEQ ID NO: 2249377 - RNA, 99 nt, Homo sapiens
aguacaagaucaaggugccagcaggguugaugaccaccucuuuuuugccucuugauguugucaucaucaguccucugugcacaugugauccuggugucu

SEQ ID NO: 2249378 - RNA, 55 nt, Homo sapiens
cagauagccagugguccucauggucagaggaggggugaggucauugggcuuucug

SEQ ID NO: 2249379 - RNA, 64 nt, Homo sapiens
gggucucugugcaugcgcggagcugaaagggagcguuuugcagaucuccacgcgugcgcaacuc

SEQ ID NO: 2249380 - RNA, 89 nt, Homo sapiens
gcaaauuaaacaguuccuaggauuuucauucuuucuuccaauagaucugggaugaagaagaauaguucguauucucguuuguaaauugu

SEQ ID NO: 2249381 - RNA, 120 nt, Homo sapiens
ggcguuauuucaaauucauauaaaggguacuucuuacaaaauagccucuaccaaagauacauuuugagcauguaucuuugguagaagcuauuuuauaagaagauggagaggcuaacagcu

SEQ ID NO: 2249382 - RNA, 129 nt, Homo sapiens
ggauuauuacaauucaaggugaaauguggguggggacacagcaaaacuauaucaaugauaaaauguaagugauauggcuuggcuaugucaccacccaaaucucuucuugaauuguagcuccuauaaucc

SEQ ID NO: 2249383 - RNA, 70 nt, Homo sapiens
accuauaauaucagguugugaugaugagauguggaggaagaguccgucaacaagaaaugauauuuuaggu

SEQ ID NO: 2249384 - RNA, 56 nt, Homo sapiens
ccccacuuguguuuuaggggaaucaagucguugauucuucaguuacaacaaggggg

SEQ ID NO: 2249385 - RNA, 105 nt, Homo sapiens
guugcccuggugggcugccugaaacugcagugggcuuggcaugagugagaguuggauuucuguuguguuaccuacugcgauuugggggcuguuuguuagggcggc

SEQ ID NO: 2249386 - RNA, 101 nt, Homo sapiens
cugaacacacuaaaaccuauuuaauuuuauacucugcauugaugaauuguauggugugugaauuaaauguuaauaaggcagguguguguguguguguucag

SEQ ID NO: 2249387 - RNA, 108 nt, Homo sapiens
cagcaguguaaagguguucccuuuucacuacaucuaugcuaacaucaauuuuuuuuaauuuuuugauuauggccauucuuguaggaguaaggugguaucucacuguug

SEQ ID NO: 2249388 - RNA, 57 nt, Homo sapiens
gacuacuaggacagggaagaauuggaaaauuguguuuucuucccuguuuuuucaguc

SEQ ID NO: 2249389 - RNA, 57 nt, Homo sapiens
ggagagaaaguaaucauuucuugccuaugggguaauagggaaugcaaauucucaucc

SEQ ID NO: 2249390 - RNA, 64 nt, Homo sapiens
gcuugaagcugagaggcagagguugcggugagccgagauugcgccauugcacuccagccugggc

SEQ ID NO: 2249391 - RNA, 95 nt, Homo sapiens
cuccaaacaaaugugaacugaucuaguuaguguucauaaauuugcauaaaguugagcauuguuuggacuuggauuauuuuguccuugcuuuggag

SEQ ID NO: 2249392 - RNA, 64 nt, Homo sapiens
ugauucaugguugguuaaaucuguguaugcagaacccauguauacagagagcaaacuguaauca

SEQ ID NO: 2249393 - RNA, 92 nt, Homo sapiens
gggcauuccucccaacuccacuaggcugaggcuggacacagcuaggguccccaucguugguuccuuagccuaggacuagggagaccaugccc

SEQ ID NO: 2249394 - RNA, 69 nt, Homo sapiens
uuugacuauaucaggaauggggauuaaauuugcauugcaggugaauuccaagccuccuuguaagugaga

SEQ ID NO: 2249395 - RNA, 88 nt, Homo sapiens
ggagaaucacuugaacccgggaggugaggguugcagugagccgagaucgugccacugcacuccagcuugggugacagagugagacucc

SEQ ID NO: 2249396 - RNA, 76 nt, Homo sapiens
gcacacauccccaaauaguugucagucuuagagaauucagaccauuuccagguuaacaucuauuuuggaugagugu

SEQ ID NO: 2249397 - RNA, 99 nt, Homo sapiens
uuccuauaaggauccuaucacaguugcauauuuaaggacuacgaaaugaacguauuuuaaggcaugaacugugacuaaaugauggggcagggauaggag

SEQ ID NO: 2249398 - RNA, 114 nt, Homo sapiens
gcugaacauaagcuuucuuugguuuuguuugaagucgagacaacugggguuuuauccuucgguaccagucagucauugacuauagaccacccagggugauacguauuuucaagc

SEQ ID NO: 2249399 - RNA, 127 nt, Homo sapiens
aagacauuacucuuuaagagcaguuuuagguucacagcaaaauugagaagggaauauauaggaaaucucuguaacuuucucucaauuuugccgugaaccuaaaacugcucuuaaagaguaaugucuu

SEQ ID NO: 2249400 - RNA, 65 nt, Homo sapiens
aaaaaucuguaagagagcuuauugaguuauuagcaucaacaucaacugcacuaggacagguuuuu

SEQ ID NO: 2249401 - RNA, 101 nt, Homo sapiens
agugagagguauggcagaagaggugaggagucagacugugcaaggucuuagaggacuuuuagggauuuuggucauuugccuaucugcaaugggaaguuacu

SEQ ID NO: 2249402 - RNA, 64 nt, Homo sapiens
auugugaauagugccgcuauaaacauaugugugcaugugucuucauagcagcaugauuuauaau

SEQ ID NO: 2249403 - RNA, 89 nt, Homo sapiens
uaauuuuggggggugaguuuguaauuguauuuaguuguuaugggaauaacaguauauuuaccaaaccuuucaccuucuaauuagaguua

SEQ ID NO: 2249404 - RNA, 89 nt, Homo sapiens
uuuuccacagcagcuugucaagagcuuuaucuuuucucccaucuguuuggauuggauacuuaacagcucuacagcugcucuuuggagga

SEQ ID NO: 2249405 - RNA, 56 nt, Homo sapiens
aaggggugaacacaguacuugauagguuguuuuucaaucacugucuguuuccccuu

SEQ ID NO: 2249406 - RNA, 94 nt, Homo sapiens
gaggcagaagaaucgcuugaacagguggagguugcagugagcugagguggcgccauuguacuccagccugggcaagagagugaggcucugucuc

SEQ ID NO: 2249407 - RNA, 69 nt, Homo sapiens
gagccauguagaaugaaccucaaaaauguccaccugcgggacaaaagaaaggagcauuuacauuggcuc

SEQ ID NO: 2249408 - RNA, 129 nt, Homo sapiens
ugacgugcaaggcuugacugaugaauaaaagccuuaccacagucauuacacuuguaagguuucucuccaguaugaagucuaugaugacgugaaaggugugauuguugauuaaaagccuugccacauuca

SEQ ID NO: 2249409 - RNA, 108 nt, Homo sapiens
guguagauuucagauggucaaggugccaugagggagggguggugccgcacaacagugcugucauucauccuuuccuuucagcaucuuaugacgguuugcaguuuauau

SEQ ID NO: 2249410 - RNA, 99 nt, Homo sapiens
uaguacuuguagacuuggcuuuccccgugaaacuuucucauuccugauauuugaguagcugggaagguaaucauguggucaguaucauuuacugugcua

SEQ ID NO: 2249411 - RNA, 81 nt, Homo sapiens
agccagaauuacugcaguaaccacuguaggugugugugguguggcuuuagacacuuauuugugguaguguuuauuuugguu

SEQ ID NO: 2249412 - RNA, 122 nt, Homo sapiens
caggaagaauaaauggauggggaacagauuaacugguaaauaguucucuuuggaauuugaauacauuugagagacagacauuaucuuauauaagagucuguucuugugugguuaaauucuug

SEQ ID NO: 2249413 - RNA, 72 nt, Homo sapiens
aaauuuagugcaaacucuucaaugcugguuccacauuuggcaccuggcuuggauugauuugccacugaguuu

SEQ ID NO: 2249414 - RNA, 76 nt, Homo sapiens
guuggaaguguguuuugagaugcgccaaaugaaccccugcucuuuguuauguaucucaagauaaacacguuucaac

SEQ ID NO: 2249415 - RNA, 108 nt, Homo sapiens
gggcuaggcugagcagcagaggagagauuggcuguggagaguauagaugacacaugaggccaggugaucucugagaaaaguuucucccaucuguugcuuagauugccc

SEQ ID NO: 2249416 - RNA, 57 nt, Homo sapiens
gggucauggaugugaagcuagaacuccuugacaagcaggagcuuuauuuuauggccc

SEQ ID NO: 2249417 - RNA, 85 nt, Homo sapiens
gccugauuggaaugcacacugagccugccuagggaaauuaggcuuaauucuggcucaguuuccuguauucuccuguaauacuggc

SEQ ID NO: 2249418 - RNA, 93 nt, Homo sapiens
uggagaagcuuaucaggaucacucccaaugucaauuaaugauguuuuaaaaaaugacauugggagugaagugaagaaagcaaaccauucucua

SEQ ID NO: 2249419 - RNA, 109 nt, Homo sapiens
agaucaucagguauuagauucuuauaaugagcaugcaaccuaaucccucacaugcacaguucacaauaggguuugugcuccuaugagaaucuaaugcuacugcugaucu

SEQ ID NO: 2249420 - RNA, 75 nt, Homo sapiens
gcuguucuuaggugggccaucaccccacccugcuuuuccucacccucuguggguugagucgcccaccuagucagu

SEQ ID NO: 2249421 - RNA, 88 nt, Homo sapiens
accauaugucacuuuacacuguacuuuaucgugugaguuuuguguuuucacacugaauuugaagcaauguaaggccgacaccuauggu

SEQ ID NO: 2249422 - RNA, 58 nt, Homo sapiens
guuugcagaucaugaagaacccuauacaccauaguaauggcuuuuuacuucugcggac

SEQ ID NO: 2249423 - RNA, 70 nt, Homo sapiens
ggugcaagcuguugguggauguaccauucuggagucuggaggaugguggcccucuucuaacagcuccacu

SEQ ID NO: 2249424 - RNA, 88 nt, Homo sapiens
ggagucucgcucuguugccuaggcuggagugcaguggugugaucucggcucacugcaaccuccgccucccggguucaagcgauucucc

SEQ ID NO: 2249425 - RNA, 82 nt, Homo sapiens
aguucuaggguacacgugcacaacaugcagguuuguuacauagguauacaugugucauguugguuugcugcacccaucaacu

SEQ ID NO: 2249426 - RNA, 103 nt, Homo sapiens
cugaggcagaagaaucgcuugaacccgggagguggagguugcagugagcugagauugcaccacugcacuccagccuuggagacagagcgagacucugucucgg

SEQ ID NO: 2249427 - RNA, 57 nt, Homo sapiens
uuugcauggagcucucuuuggacuguagcaucuauagucuuccuaccuccauccaaa

SEQ ID NO: 2249428 - RNA, 83 nt, Homo sapiens
cagaugaucucaugugcuguuagaggaaguguaaauuagucaacacuuucuggagcugcacauauucugauuuauccaaucug

SEQ ID NO: 2249429 - RNA, 72 nt, Homo sapiens
gcagucccaaucuguggcaaagucuugugaauauccuuaaugugauaaaacuuugccuuagacggaguuugc

SEQ ID NO: 2249430 - RNA, 72 nt, Homo sapiens
uucuugauuaggaggacuuuaugguggcaaugcaaggacuguccuuauguuuuggagguccucacuagagaa

SEQ ID NO: 2249431 - RNA, 62 nt, Homo sapiens
uugguuugccaguauuuuauugaggauuuuugcauugguguucaucagagauauuggucuaa

SEQ ID NO: 2249432 - RNA, 76 nt, Homo sapiens
gaagugaaucuuuuuugggauggaacuuuucagugaaaccuauaucacugaaaucaguucugcccauucauacuuc

SEQ ID NO: 2249433 - RNA, 67 nt, Homo sapiens
uugaggaggcagucuguccauucucagagcucaaaugcuaugcugggagaaccacugcucucuucag

SEQ ID NO: 2249434 - RNA, 101 nt, Homo sapiens
uggguccuuugaaucugaagagucuacuuaguauugcagaaucuugguuacauuguuuagcaauggagggugacuuuaauuguagauaaggagaaauucca

SEQ ID NO: 2249435 - RNA, 79 nt, Homo sapiens
ugcaucucuggugagguaguaagguacaauacuagcacuccaccuagugucuaucuaugauacuucacacucugaugca

SEQ ID NO: 2249436 - RNA, 70 nt, Homo sapiens
acugagacugagaauguuucuugggucauagauucccauugucagcuuacagcauucuuagugucucagu

SEQ ID NO: 2249437 - RNA, 72 nt, Homo sapiens
aggaaugcuuuuacacuguuggugggaguguaaauuaguucaaccacuguggaagacaguguggcgauuccu

SEQ ID NO: 2249438 - RNA, 60 nt, Homo sapiens
uagaaggggauuauucugcccagggauggcuuaacugggauggaaugcagccuccuucug

SEQ ID NO: 2249439 - RNA, 79 nt, Homo sapiens
ggguuuuugaggaauuggucuauuaaaccuaaguuuuaaaauuuauguguguagaguucaaaguauuuccuuauuaucc

SEQ ID NO: 2249440 - RNA, 76 nt, Homo sapiens
ucacuugagccugaaaagcagagguugcagugagcugagaucaugccacugcacuucagcuugggggacagaguga

SEQ ID NO: 2249441 - RNA, 107 nt, Homo sapiens
cuaggaguuuuuguuuguuuguuuguuuuugagauggagucucacucuguugcucaggcuggaguguaauggcgccaucucagcucacggcaaccucugccuccugg

SEQ ID NO: 2249442 - RNA, 56 nt, Homo sapiens
aggcagagguugcagugaguggagaucaaucgcgucaugucacugcacucuagccu

SEQ ID NO: 2249443 - RNA, 130 nt, Homo sapiens
aaguuauacaucuaggagugggauugcuaggucauaggguauguggcuauucaccuuuaugaaauaaugcaagauaguuuuccaaagugaauguuacaauuuuauuaucccacuacaguuuuuaagacuu

SEQ ID NO: 2249444 - RNA, 88 nt, Homo sapiens
ggagaaucacuugagccugggaggcagagguugcagugagcuaagaucgcaccacugcacuccuccuugggugacagagugagauucc

SEQ ID NO: 2249445 - RNA, 123 nt, Homo sapiens
gaccagcaacaucagcaucaccugggaguguguauggaaugcagauucucaggaccccagcccaggcuuccugagucagcauccguuuguaaugagcucccugggggauuugaaugcuccguc

SEQ ID NO: 2249446 - RNA, 65 nt, Homo sapiens
ucacuggccaaauucugggugaguguuccuugacaguuguuuagccauagaaccuuagccaguga

SEQ ID NO: 2249447 - RNA, 75 nt, Homo sapiens
gggauugggaacaugagaaugugaaugagacuuggaaaaacaagccacucuuuauuuuucauuuuuuugaauccu

SEQ ID NO: 2249448 - RNA, 57 nt, Homo sapiens
aggcaagcaucuugcucccuucuuacaaagaaacagaaguggugaaguaacuugccu

SEQ ID NO: 2249449 - RNA, 56 nt, Homo sapiens
guuaauguucucaccacagaaccauaauaauuuggugaugugauggauauguuaau

SEQ ID NO: 2249450 - RNA, 61 nt, Homo sapiens
caaaggcucaaggaaaauaauggucaaaaucauugacaguguccuccuccugagagauuug

SEQ ID NO: 2249451 - RNA, 85 nt, Homo sapiens
uuauucacagcuauuuuaugagcaccuaagauagugccuagcacaugcaagguauugaguaaauguuuauuggguaagugaauaa

SEQ ID NO: 2249452 - RNA, 60 nt, Homo sapiens
ugggcaauggcucugauguuguugugacuucugaugucaccaccagaagagcuauucuca

SEQ ID NO: 2249453 - RNA, 93 nt, Homo sapiens
ccauuuguaugucuucuuuugagaauugucuauuuacguccuuugcccaccaaaagaacaugguacugauuuacgaaauaggcagacaaaugg

SEQ ID NO: 2249454 - RNA, 82 nt, Homo sapiens
cucaguuccuucauugcacucccagacacccucaucaccguguagaugcccgagggucugugguggugcuugucgggcugag

SEQ ID NO: 2249455 - RNA, 101 nt, Homo sapiens
aaacugagcacguaagucccauagcuaguucguguuugaacuagaucugaauuccagauguauuuccaacugaaugaucugucuaauauacuguucuguuu

SEQ ID NO: 2249456 - RNA, 68 nt, Homo sapiens
ggcacuagauucucacaggagcgugaacccuauuguggguugcacacucuguaugagaaucuaaugcu

SEQ ID NO: 2249457 - RNA, 123 nt, Homo sapiens
uuuugguugggcauuuugcaugggcgauaguauauucuuaguuggaaugggauaaggagcccugaaugcuuuuuaaaauuccaugcuaaaacugugaauugggccuaauggaagccccuagaa

SEQ ID NO: 2249458 - RNA, 69 nt, Homo sapiens
ggagaaugaguuguguggcuaucacuggaaggaaagaaaggguccaauguauagaucugauucaucucc

SEQ ID NO: 2249459 - RNA, 76 nt, Homo sapiens
auguaggaagugccuuggucuuugaugauuuuucagagcccuugagugaacgcugagaccaaaugcuuccagacau

SEQ ID NO: 2249460 - RNA, 63 nt, Homo sapiens
ggucauaaagacacuuggcaugauuucagucuucucaaauuuguuaaggcuuguuuugagacc

SEQ ID NO: 2249461 - RNA, 56 nt, Homo sapiens
gccuuguuucucaccucgaauaccguaauuacuuccucguugguagagagcagggc

SEQ ID NO: 2249462 - RNA, 57 nt, Homo sapiens
uuauuuauauucaguguggaucucugagcaugguucaagcacauugaguguguguga

SEQ ID NO: 2249463 - RNA, 60 nt, Homo sapiens
gagagaggaguauagcacugaccauauagccaggaucaguaaaugcuguucucuuuucuc

SEQ ID NO: 2249464 - RNA, 84 nt, Homo sapiens
caauucuggucuuuaugacugcaaagcauauacucuuaacccaaacuggaagauauguuaguuauaaacucuuugccggaagug

SEQ ID NO: 2249465 - RNA, 72 nt, Homo sapiens
gucagccugucggcuccuucauucuggccacacaucacaacaguccaugaaugcagcagugacagggcuggc

SEQ ID NO: 2249466 - RNA, 81 nt, Homo sapiens
guuugcucacaaguagcacaugccacccugucucuuuugcagagacagggucucacuguguugcccagacugaucucaaac

SEQ ID NO: 2249467 - RNA, 77 nt, Homo sapiens
ggcuguuuaugcugcuauaaacauagguauacugugguagaauauagauauaucuguccauggcccugcuuucaguu

SEQ ID NO: 2249468 - RNA, 72 nt, Homo sapiens
ggcuucuagguuugacucaagcaugagacaagucauggguggaugucucauugcaguuagaccugugggguc

SEQ ID NO: 2249469 - RNA, 58 nt, Homo sapiens
gguuggaaugguacuaugaaggugaaaucuuaccuucauuguugccauguccacugcc

SEQ ID NO: 2249470 - RNA, 77 nt, Homo sapiens
cauguuuauuuuaauauguauacagacagauacagaaacagauguagauguguguauaugugugguuaguaugcaug

SEQ ID NO: 2249471 - RNA, 70 nt, Homo sapiens
uagucauuuuuggauauagggaaggauucuuccuugaaugaaccuugccucuuauucaaucaaaagacug

SEQ ID NO: 2249472 - RNA, 81 nt, Homo sapiens
ucugcuucagcuugggagucuucacuaaguggugaaaugauggagucaucacucggugaugauucuuaaaauaagaacaga

SEQ ID NO: 2249473 - RNA, 55 nt, Homo sapiens
uucacaaccauaaaauuaugcuggucucuugaaaguauuaguuuaugggugugga

SEQ ID NO: 2249474 - RNA, 73 nt, Homo sapiens
uuccuguuucugaagauaucauuucagccaaaaguuacagauugagcucugucugauauuuucugagcaggaa

SEQ ID NO: 2249475 - RNA, 62 nt, Homo sapiens
ggagaaacuggaccuggcuuuaccuugaguucuuaagcaaguaacuggccuucaauuucuuc

SEQ ID NO: 2249476 - RNA, 63 nt, Homo sapiens
aagcuuagacaacaacuuuguagaaugaguauaccucacaaagcaaaggaauugccuaagcuu

SEQ ID NO: 2249477 - RNA, 76 nt, Homo sapiens
uuaugcuuauucaccagguagaagaaauaaauauaagaaacuauuuugucuugucuuguacuuugagugagcaugg

SEQ ID NO: 2249478 - RNA, 87 nt, Homo sapiens
caguugauuguuuuucaugacguguguuagcuggguaguuccucuacuggucucaccuagacucgaucauguagcuacauucagcug

SEQ ID NO: 2249479 - RNA, 126 nt, Homo sapiens
uacagcugcauaaagugaacugcuuuaccuguaugguuaguucccucauucuugacuucugugguucccacagaagagguggguggacuagcaggaggacuggcaguaaagcuugugcacccugua

SEQ ID NO: 2249480 - RNA, 95 nt, Homo sapiens
gugugcuggggaugggauggaauuaaaaucagaaucauugucuuuccuuuuuaaauuuugcaguggugcugugggcugauaccuccuucacacau

SEQ ID NO: 2249481 - RNA, 89 nt, Homo sapiens
gccgaagcuauggauuugcauuccccaugucauuuuaguuaaaaugaggaaugcuuggaauuuauauauaaacagcauuguguuuuggc

SEQ ID NO: 2249482 - RNA, 114 nt, Homo sapiens
gacuacuucauguauagaaguucucacuugcguuuaaugcuuugugaaauagauuccaacuagucagugucuguaaggagaacccuuccaauauacuccuugaaaagaguaguu

SEQ ID NO: 2249483 - RNA, 84 nt, Homo sapiens
ggcaccuguaugucugggugugggacucgggcucuggaauggaaugaagggugugaucaugcuccaggcgagaaccugggugcc

SEQ ID NO: 2249484 - RNA, 60 nt, Homo sapiens
ugacauggagggugcggcugcaggccccagguacauucccagcagcugcccauccuguca

SEQ ID NO: 2249485 - RNA, 61 nt, Homo sapiens
ucuggcccucagacucaugggcacauucagaagucuugccuacugagacuggguggccagg

SEQ ID NO: 2249486 - RNA, 85 nt, Homo sapiens
ucucaugaugugaccaucuggagguaagaagcacuuuguguuuugugaaagaaagugcuuccuuucagaggguuacucuuugaga

SEQ ID NO: 2249487 - RNA, 111 nt, Homo sapiens
aucucaacuaaguacaucugugaagauccuguuuccaaaucaggucacauuuugagguucuagguggacaugaauuuuggaggcauacuauucaacucaguauguggagau

SEQ ID NO: 2249488 - RNA, 63 nt, Homo sapiens
gcaggguucuuugucuacauccuguuaaaucaugguuuaaacugcccagacugaagacccugc

SEQ ID NO: 2249489 - RNA, 82 nt, Homo sapiens
aguuuuaggguacaugugcacauugugcagguugauuacauauguauacaucugccaugcuggugugcugcacccacuaacu

SEQ ID NO: 2249490 - RNA, 58 nt, Homo sapiens
ggcuugaguccaggaguuugaggaucuaguaagaugaucaugccacugcacuuuagcc

SEQ ID NO: 2249491 - RNA, 62 nt, Homo sapiens
gccuaugaugcuguuuagaaucucucuauauagcaggaaagauggcugucaguauccuaggc

SEQ ID NO: 2249492 - RNA, 60 nt, Homo sapiens
uuucccuuuguuaaauuggaagaguuuagaaugaaaacucuuuucacagacaaauggaga

SEQ ID NO: 2249493 - RNA, 65 nt, Homo sapiens
aggaagauaauuucagaaaagugauacgaacgugauaucaaaguuucccagaaguugucuauccu

SEQ ID NO: 2249494 - RNA, 63 nt, Homo sapiens
ggcggcuuguguuugcuccccagaauauucauauuuuaaauauuggaacaagcagcaaguguc

SEQ ID NO: 2249495 - RNA, 61 nt, Homo sapiens
uauuaauacuuccaaaucuagucauuucugcagggcaaugaaauagauuuggaaguuggua

SEQ ID NO: 2249496 - RNA, 68 nt, Homo sapiens
ggguacaugugcacaacgugcaggcuuguuacauacguauacacgcgccauguuagugugcugcaccc

SEQ ID NO: 2249497 - RNA, 62 nt, Homo sapiens
auuucucagcucauggucucugaugguuaauauuaugugccaauuugacugggcugaggaau

SEQ ID NO: 2249498 - RNA, 69 nt, Homo sapiens
guaagcuaggguuaauuuauuauugaagaaaaaauauuuuuaaauaaauugaguguagccuuaguguac

SEQ ID NO: 2249499 - RNA, 58 nt, Homo sapiens
uaggaagugagagugaaaauaucagaguugacauuuccauuucuggcuuucacaccug

SEQ ID NO: 2249500 - RNA, 60 nt, Homo sapiens
aaagcauccagcauggaacugaacucaacuuggauuuguucagaggugacuggguguuuu

SEQ ID NO: 2249501 - RNA, 112 nt, Homo sapiens
ucuguugguuucuggaaaauugccuuuauuauagcuaaauagauuccuucuacuuauuacuuauuaggaaugacuuugggacuguauuaaaugccuuuucagcaucuacaga

SEQ ID NO: 2249502 - RNA, 57 nt, Homo sapiens
ugaacuguugggggaaauucagccagauaucaggcaaaauucacccccgauauuuca

SEQ ID NO: 2249503 - RNA, 60 nt, Homo sapiens
gaggguacagggcuaaacaagucaucuccauaaagguccucuugccuagcccuuugccuc

SEQ ID NO: 2249504 - RNA, 100 nt, Homo sapiens
cuuugacguggauccccuggagaucuuguuaaaguacagauuaugauucaguagggucugaaauucugcauuucuaauaagcuccaaggucauauugaag

SEQ ID NO: 2249505 - RNA, 66 nt, Homo sapiens
ggaaggugguggaaugucuauguuuuugauuuuacugugaguuaaaaaggcacauuucuaccuucu

SEQ ID NO: 2249506 - RNA, 68 nt, Homo sapiens
uuccuacaaaguacuguuuaaauugcagaacaauuuccaguuccacuguagcaaaaaguacuuaggaa

SEQ ID NO: 2249507 - RNA, 77 nt, Homo sapiens
ggaaguguuaacggucauuaucaguuucagcccuaccacuuauuagguuuguaacucuagugacuagaugcacucuc

SEQ ID NO: 2249508 - RNA, 113 nt, Homo sapiens
cucccccacuucuacccuuuaaauguccagggacuguuucuacauuugguucagacagacugagcaaaauuuuggacauagauggacaauugcuggauagacagcugauggag

SEQ ID NO: 2249509 - RNA, 119 nt, Homo sapiens
auacgugguuucacaaggugugcggugguagggaguugauaugcuugucaguccauuugaaucucaugauggcauugaauguguguuuccccuuugcagugaaccuggagaccaugugu

SEQ ID NO: 2249510 - RNA, 99 nt, Homo sapiens
ggccuuuggacccugggacucacacuggugcaaccacuccccgcagguucuuggccuuggacugagaguuccaccauugguuucccugguucugaggcc

SEQ ID NO: 2249511 - RNA, 64 nt, Homo sapiens
gguuguggaagugaacaaccaaggcaggugguacugccauuuccugauagaacacuuuccaauc

SEQ ID NO: 2249512 - RNA, 63 nt, Homo sapiens
guuguuuguuuauucuaaggccugauucucagaaaggaaauggucauagagcaagcaaacagc

SEQ ID NO: 2249513 - RNA, 79 nt, Homo sapiens
cuuaaaggaauggcauggugaagucuuuggaacacgcauacuuuugcuuccuucacaccacuauguuauucuaucuaag

SEQ ID NO: 2249514 - RNA, 63 nt, Homo sapiens
uuuggcuauguuguaucuuuccaaacauucucacgguagagagaaauagccuuauuagccaga

SEQ ID NO: 2249515 - RNA, 59 nt, Homo sapiens
ugguccaucccuuuagggaauaugccuaaccuuuagguaauuuucccagagggaaacua

SEQ ID NO: 2249516 - RNA, 85 nt, Homo sapiens
guagaugaaauauagguauuuuuaaaugacuguugaagaaaaauggcucugauauggcaaauuuaaaaguaucugaauuuucuac

SEQ ID NO: 2249517 - RNA, 68 nt, Homo sapiens
ggaagaugaaaggauagucugaugccauguaaaaaauuuaggauaugagauuauaaucuuuuacuucu

SEQ ID NO: 2249518 - RNA, 101 nt, Homo sapiens
gccuccuccuucugccaggagcgacauugguugcuuugguugggggaagcccguguucagccaacacccagugggguuccuggacaaggguauagagaggc

SEQ ID NO: 2249519 - RNA, 91 nt, Homo sapiens
ggguuuguauaaggcugaguauguccuguuuuuaagguucauaggcucuaggcuuauucuuuaaaaaauagggguggccuuucauauuccc

SEQ ID NO: 2249520 - RNA, 55 nt, Homo sapiens
uugagauggagucucgcucugucacccaggcuggagugcacuggcacuaucucag

SEQ ID NO: 2249521 - RNA, 56 nt, Homo sapiens
ucaaaguauucuucugagaaccuucuugguaaaaggcucucagaaugaaauuuuga

SEQ ID NO: 2249522 - RNA, 88 nt, Homo sapiens
auguggccuguggggcagaugucuggacaccucaugcuuuccuugccuuagcugaaagguuauuuaggucugcuuguucaggccacau

SEQ ID NO: 2249523 - RNA, 107 nt, Homo sapiens
ggaggcugaggugggaggauggcuuggaccuggaagauagagguugcagugagcugagauugcacuacugcacuccagucuaggucauagagccagaccuugucucc

SEQ ID NO: 2249524 - RNA, 67 nt, Homo sapiens
ggaccacauuaccuugcuugcuccaacuuuauaguaagucuugaagucagguaauguaauguaauuc

SEQ ID NO: 2249525 - RNA, 64 nt, Homo sapiens
auugugaauagugccgcagucaacauaugugugcaugugucuuuauagcagcaugauuuauaau

SEQ ID NO: 2249526 - RNA, 57 nt, Homo sapiens
gagauggagucucgcucugucacccagauuggaguguaguagcacgagcucugucuc

SEQ ID NO: 2249527 - RNA, 89 nt, Homo sapiens
agaacagccugucuccuaugagcuuuuuuaagccucagaauguuaaagcuggugagggacuuagaagggacuaagagacuccucguuuu

SEQ ID NO: 2249528 - RNA, 66 nt, Homo sapiens
cauagguagcauagcaggaauauuagugguagguuguugcugucuguguuguugcuguggccuaug

SEQ ID NO: 2249529 - RNA, 78 nt, Homo sapiens
gcaucugaauauagaaucaucugugcacuaguaaauuaagcuguauacuagucauuuaggugauauuauaacagaugu

SEQ ID NO: 2249530 - RNA, 63 nt, Homo sapiens
uaagaggaauguuaaggcgcuguuggucaaugugaucuguagcccuuuuggcauugaaucuug

SEQ ID NO: 2249531 - RNA, 74 nt, Homo sapiens
uggggucauuauaguacuuaccucacaccuuugaacuuugagguuuaagugagauaaugcaugugaagauccua

SEQ ID NO: 2249532 - RNA, 94 nt, Homo sapiens
uugguauuagggugauacuggcuuuauagaaugauuuagggaggauuccuuuuuuaucuauccuguagaguagugucaauagaauugguaccaa

SEQ ID NO: 2249533 - RNA, 62 nt, Homo sapiens
cucaucauaacucugaaaacucuacuuccaaauugcacucugaguuucaggguggacaugag

SEQ ID NO: 2249534 - RNA, 65 nt, Homo sapiens
uguagggugguuguagcuacaucugaauaagacacuuuuggaaaaugagauaguaauccccuaca

SEQ ID NO: 2249535 - RNA, 57 nt, Homo sapiens
guuggaacacaaaagagauccuucaaggauuuuacagucuuuugugugagucccaac

SEQ ID NO: 2249536 - RNA, 60 nt, Homo sapiens
gaaccuccgccuagauuucagaggauguauggaaaugccugaauguccaggcagagguuu

SEQ ID NO: 2249537 - RNA, 68 nt, Homo sapiens
caagcacaggggauuuaucagggcagugaaacuaguaugguaauacuguaauggugguuccgugcuug

SEQ ID NO: 2249538 - RNA, 104 nt, Homo sapiens
guugauacaaguaauuaaacauuuguccaaauccaugggauguacagaaucaagagugaagccuaauguaaacuauggacuuugggcaauaauuaugugucaau

SEQ ID NO: 2249539 - RNA, 71 nt, Homo sapiens
uguauuuuuaauagagucaggguuucaccauguuagccaggauggucucgaucuccugaccucgugaugca

SEQ ID NO: 2249540 - RNA, 122 nt, Homo sapiens
gggaacaucgacuuguauguuaucagugaccaaagaggcaggcauuagagggccaaaagcuuucaaaccacuuugagugugguucuuaggcgcacugguggagcuacacccaagauguaccc

SEQ ID NO: 2249541 - RNA, 58 nt, Homo sapiens
gucauaucauuggccaguggaagccucuucaaguugucuccugugucuuagauaugac

SEQ ID NO: 2249542 - RNA, 87 nt, Homo sapiens
ucucaugcugugacccucuagagggaagcgcuuucuguugucugaaagaaaagaacgcgcuucccuauagaggguuacccuuugaga

SEQ ID NO: 2249543 - RNA, 68 nt, Homo sapiens
uugcuugaaccuggaaggcagagguugcagugagcccacauugcaccacugcacuccagcuugggcaa

SEQ ID NO: 2249544 - RNA, 77 nt, Homo sapiens
aguagugucuaggggugggugucugugacuccugaagcccaagugggcauaucgcagugcacucuuuuagcuuugcu

SEQ ID NO: 2249545 - RNA, 74 nt, Homo sapiens
aguuaccaaacagauaagaacaguuauccauucaaagcaguuucagcuuugaauggauccaauucuuaguagcu

SEQ ID NO: 2249546 - RNA, 76 nt, Homo sapiens
accgugccuggccaacaccuagcuaaguuuuguguauguuguagagacaggguuuggccauguuggucaggcuggu

SEQ ID NO: 2249547 - RNA, 68 nt, Homo sapiens
uugcuugaaccuggggggcggagguugcagucagccgagauugcaccacugcccuccagccuggguga

SEQ ID NO: 2249548 - RNA, 87 nt, Homo sapiens
uggauacagugcugcacauuuuuuugagacuauuuuauucauuuauuacaguggauagaacuaagugcuuagaacaguauugauuua

SEQ ID NO: 2249549 - RNA, 96 nt, Homo sapiens
cuuuuuuaaaaauucuaacgacuuccauaauuugcaucucaucuauucaggugagguaggaaaaguuaggaaugguuuguuauuauuuauaaaagg

SEQ ID NO: 2249550 - RNA, 60 nt, Homo sapiens
ccugaaaauauccucuccuuugcauacgggaacacacagaugggaggaugcgucuucagg

SEQ ID NO: 2249551 - RNA, 77 nt, Homo sapiens
uggccaggcuggcaucgaacuggugauccacccgccucagcgucccaaagugcugggauuaccaccgugccuggcca

SEQ ID NO: 2249552 - RNA, 73 nt, Homo sapiens
uggcucggagcagacaugaggaccgcuggcaccuccucagcccucucugugcucugcugccugccccgaguca

SEQ ID NO: 2249553 - RNA, 64 nt, Homo sapiens
ccauauuuuugcaguacuucuggcuuuacagauaugucuguguaaucugaagcugcaauuaugg

SEQ ID NO: 2249554 - RNA, 128 nt, Homo sapiens
gagaaagggagagacauaauaagaugagauagaaauuguccaaauguuuacuuuuaccauccuuucaaucagaauuugaauauguuaaauaauguucuguccauauguccugugguccucccuaucuc

SEQ ID NO: 2249555 - RNA, 66 nt, Homo sapiens
augucuaacauuuuugucuaagaaacuugcacuugugucucugcauucuaaguaaauguuggacau

SEQ ID NO: 2249556 - RNA, 61 nt, Homo sapiens
uggugcaguugggcaaaaaugaggaaaucuuuucuggucuggguuuugcuuaacugcgcca

SEQ ID NO: 2249557 - RNA, 88 nt, Homo sapiens
gugggcuuaaaaccuugaugacagguugauaggugcagcaaaccaccacggcacguguauaccuauguaaccugcacguucagcacau

SEQ ID NO: 2249558 - RNA, 62 nt, Homo sapiens
gaucugaguggugguuacacgaauaauuuuuuuuaaguuuauguaacugcaaaccucagauu

SEQ ID NO: 2249559 - RNA, 82 nt, Homo sapiens
caguuuccauguaguugugcaguuuuaagugaguuucuuaauacugaguucucauuugauugcacuguggucugagagacug

SEQ ID NO: 2249560 - RNA, 110 nt, Homo sapiens
agcugcuccaugucaugccuggucgugcuucuuugucauauaggcugcugccaguggcgcgggcacugugaugugaggggguagggccuuucggguggcaaggagaagcu

SEQ ID NO: 2249561 - RNA, 59 nt, Homo sapiens
uauucacuguaucauugaugggcauuuggguugauuccacgucuuugcuauugugaaua

SEQ ID NO: 2249562 - RNA, 56 nt, Homo sapiens
uucuuggcuugguaucaaauaaccaguucuugguuaugugcuggcugugccaaggg

SEQ ID NO: 2249563 - RNA, 76 nt, Homo sapiens
guuacaucacagguacuauggcugacaauucucuaaacuuggcagcucugucagccuuggacauagugaugauagc

SEQ ID NO: 2249564 - RNA, 66 nt, Homo sapiens
gugguguuauccugucuuuacauacaauguuaaggauguuguugcaaagcacagagacaauauuau

SEQ ID NO: 2249565 - RNA, 63 nt, Homo sapiens
auguacauucugcagcuacuuuuuacaaauugaacauuuuuugagauaguuguagauguacau

SEQ ID NO: 2249566 - RNA, 83 nt, Homo sapiens
guguacaccccucugugauaugguuuguaauauccaggggguuagagggugauauugcuccccauaucgcaguggggguacac

SEQ ID NO: 2249567 - RNA, 81 nt, Homo sapiens
auaaaucaaguaauauaaaugcauugagaacugcugacuuuuuauuagaugguaauuguuucauguauuuucuugauuuau

SEQ ID NO: 2249568 - RNA, 72 nt, Homo sapiens
gcauccuguauguuuuccugggaaauuacgguauuugauuuagauucaucaggaaacuuaugcagugguugu

SEQ ID NO: 2249569 - RNA, 72 nt, Homo sapiens
acaggugccaguguguguuguucuccgccaugugucccuguguggaaaauauaauaugcauucuuaaccugu

SEQ ID NO: 2249570 - RNA, 75 nt, Homo sapiens
gagggccaccugagguguuaacuuuacuuuuaggaguauuucuuagaagaggauauauuucauauuuuggcucuc

SEQ ID NO: 2249571 - RNA, 82 nt, Homo sapiens
gucuuuguuauugugaauagugcugcaaugaacauacaugugcaugugucuuuauagcagcauaauuuguaauccuuuggau

SEQ ID NO: 2249572 - RNA, 65 nt, Homo sapiens
uuauuaugguccaagagucagugauaucacaucugagauauugacuuucucuuagaucaggauga

SEQ ID NO: 2249573 - RNA, 73 nt, Homo sapiens
gacaugagauuuggguggggaugcagagcugaaccauaucauuaugccucuggccccucccaaaucucauguc

SEQ ID NO: 2249574 - RNA, 76 nt, Homo sapiens
ccugacuccuauggaaaggggcaauaagaagcauaaauucuugucauagguauugcacuuuuccauaggagucagg

SEQ ID NO: 2249575 - RNA, 59 nt, Homo sapiens
auucagaggggcagcugucuugggccccagugguuucccagaucccuguuccucugaau

SEQ ID NO: 2249576 - RNA, 60 nt, Homo sapiens
gcccaugagaggggcugguccaaccugagcacccuuugguaggcuggccucucucagggc

SEQ ID NO: 2249577 - RNA, 66 nt, Homo sapiens
accacgccuggcuaauuuugguauuuuuuuguagagaugcgguaucaucauguuggccaggcuggu

SEQ ID NO: 2249578 - RNA, 71 nt, Homo sapiens
aauugccuuaaucacagugucuuccuucaaggaucuggauagaugagggaaaaacuguauuguucucaauu

SEQ ID NO: 2249579 - RNA, 101 nt, Homo sapiens
ugagauggagucucacucuguugccgaggcuggagugcaguggcgugaucuccacucauugcaacuucugccucccagguucaagugauucuccugccuca

SEQ ID NO: 2249580 - RNA, 61 nt, Homo sapiens
cugugucuccucaacucaugcucgaggucagaaauggucucgguacuugagagagacacag

SEQ ID NO: 2249581 - RNA, 109 nt, Homo sapiens
agaggcaacuaggggaagggcggugaagugcaaugauccggugcugggcuggacagaagugugugcccagcgacaaggcacuucucugugagcuccagcuucugccucu

SEQ ID NO: 2249582 - RNA, 58 nt, Homo sapiens
aaaaaagacuuagauuuuucagaggaaaaccccagucugaagugugaaagucuuuuuu

SEQ ID NO: 2249583 - RNA, 84 nt, Homo sapiens
gcagccguagaguagcagaaagagcagugaagcugguauuagaaugccuggauuacaguguuuguucuguuacuuagcagcugu

SEQ ID NO: 2249584 - RNA, 82 nt, Homo sapiens
uuauucuguuaaacucugcuuuguguuguucuuaugaguaaacuugaggggguuucuacagaguagaagauuugcagaguaa

SEQ ID NO: 2249585 - RNA, 122 nt, Homo sapiens
accaucauguaacuaccaaaucaggaaauacaggguuaguauugguaauuguaauggcaaaauauuuauuuacaagcacaaauuuaauccugucacuuuccugauuuaauuuugcuaauggu

SEQ ID NO: 2249586 - RNA, 61 nt, Homo sapiens
auguauggagauauuuuugguugucaaaauaggcaaauagaugccagagaugcuccuacau

SEQ ID NO: 2249587 - RNA, 97 nt, Homo sapiens
cugccaggguaguccugaccacagggggcccgcggguggcuugggagucaacccuccucagcaucacgugggcucccguggcucagugcuuugguag

SEQ ID NO: 2249588 - RNA, 56 nt, Homo sapiens
uugagauggagucucacucuucuugcccagacuggagugcaauggcucaaucucgg

SEQ ID NO: 2249589 - RNA, 89 nt, Homo sapiens
ggagucucgcucuuguuaccgaggcuggagggcaguggcacgaugucagcucacugcauucuccaccucccagguucaagugauucucc

SEQ ID NO: 2249590 - RNA, 129 nt, Homo sapiens
aucaaagggucaaauuauugauuuuguauucaaaauggacuuaaaaagucuuaggaggaaaaaauauccugaaauaaggcauuuuuuugaguugcaagagacagguacuugguaauuuuucuuuuugau

SEQ ID NO: 2249591 - RNA, 55 nt, Homo sapiens
uguucucaaucauaugugggagccaaagaguuugaucucauggagguagagaaua

SEQ ID NO: 2249592 - RNA, 64 nt, Homo sapiens
gcccaggauuuugaagcugcagugagcuaugaucacaguugugccauugcacuccagcuugggc

SEQ ID NO: 2249593 - RNA, 97 nt, Homo sapiens
ggagauggacaagauguagaacacugaguucagggucagcccaggacagcuccuaacagccugacauguacuuauuuguuuucucuugucuauuucc

SEQ ID NO: 2249594 - RNA, 62 nt, Homo sapiens
cauucuuuguguaggugccucuggcuuugagaaacgaggccagagucuauaugcagacagug

SEQ ID NO: 2249595 - RNA, 90 nt, Homo sapiens
ccucucacugacagcauuauccugaacgugagaguuuucuuuugcuuagaugaggugauuucuguucggguuuagcuguuuugugugagg

SEQ ID NO: 2249596 - RNA, 56 nt, Homo sapiens
ucaagaucacaguuuauguuggaacuaaauuugaguuauaauaacugugaccuuga

SEQ ID NO: 2249597 - RNA, 82 nt, Homo sapiens
uguaccacaugcacaucuuuuuagucucacauuugcucaacacagauggacagaaaaaaauagauguauguuuuuggguaca

SEQ ID NO: 2249598 - RNA, 98 nt, Homo sapiens
gaggcaggagaaucacuuggaacagggaggcguagguugcagugagccaagauugcuccauugcacuccauccuuggcaacgagugaaacuccaacuc

SEQ ID NO: 2249599 - RNA, 82 nt, Homo sapiens
cccagcugauuuuccugccuccuggcugguccagugugacccaguagacagaacaauggacuaggagcuaggaagaucuggg

SEQ ID NO: 2249600 - RNA, 74 nt, Homo sapiens
cuggauauuucccauuucccccaaaugcagccugguaaccacuguauuuguuguuaaauggagaggauuucuag

SEQ ID NO: 2249601 - RNA, 71 nt, Homo sapiens
accguguagauaucauuagugcugugccacgcugacacucggucaguaccauguagauaucagugcacggu

SEQ ID NO: 2249602 - RNA, 80 nt, Homo sapiens
gggguaggguuuacagauuauuucaucgcccagguaaucagcacaguacgcgauagguaguuuuucaauccucacacucc

SEQ ID NO: 2249603 - RNA, 69 nt, Homo sapiens
ggggcuuggaaggcugaauggccucucuuaagacccacaggcagagaacauuggucuuccuauggcucc

SEQ ID NO: 2249604 - RNA, 88 nt, Homo sapiens
ucuagcacccagaucuuggguuagcaauaccauucuccaaaggcaccagucuccuuugagaacuggcugauucaaggacuggagcaga

SEQ ID NO: 2249605 - RNA, 55 nt, Homo sapiens
guguccauguguucucaucauuuagcucccacuuacaagugagaacaugugauau

SEQ ID NO: 2249606 - RNA, 84 nt, Homo sapiens
cagcacgugcuacuggaagaauaaugggccuuagagcuagcaaaacugaguucaaauccugcuuaugcuaccaguugugugcug

SEQ ID NO: 2249607 - RNA, 70 nt, Homo sapiens
gagugguagagguagacuuccuugucuuauucuaguucuuugagaaaagguuuucagcuuuuccccauuc

SEQ ID NO: 2249608 - RNA, 71 nt, Homo sapiens
gcucuccuucccuuuucuccacuaggccugagacucccuucccaugccaagagacaaagggaauccagggu

SEQ ID NO: 2249609 - RNA, 57 nt, Homo sapiens
ucccuuuagaggaggcacaagggggaaacauuaaauuugugccaaacccuggaggga

SEQ ID NO: 2249610 - RNA, 68 nt, Homo sapiens
caagacgaugauacccuauucccaaauggaugguucauacuccaauuuggcauagaguaucauucuug

SEQ ID NO: 2249611 - RNA, 68 nt, Homo sapiens
ucuuucuuauuaugcucaauguuugcaaguuucacaugaagccugaaugcaagcaugaagaguagaga

SEQ ID NO: 2249612 - RNA, 76 nt, Homo sapiens
ucacucgaacccgagagguggagggugcagugagcugagaucacgccacugcacuccaaccuuggugacagaguga

SEQ ID NO: 2249613 - RNA, 79 nt, Homo sapiens
gguuaacagucacugacaagagagaagaacuuugauaauugcucuagguuuuuuucugauugcucugaaauauuuagcu

SEQ ID NO: 2249614 - RNA, 74 nt, Homo sapiens
aguaugucugaugggagaaagaguauuuacagagauguacaaagcuccauuucugccaugagaauacacauacu

SEQ ID NO: 2249615 - RNA, 84 nt, Homo sapiens
gugcagguuuguuacguagguauacaugugcuauggugguuugcugcaccuaucaacuugucaucuagguauuaagccccgcau

SEQ ID NO: 2249616 - RNA, 75 nt, Homo sapiens
agguaguuauuuguacaggaguguaagcuucaugagggcaggaaccuugucguucugcauuccuggugccuaucu

SEQ ID NO: 2249617 - RNA, 100 nt, Homo sapiens
ucagauaaaacaauuuguauuugacaacccagaagacacuuaaaaucuuggcagaccaucauugugucauuguggugcagauauaaagaagugcauuuga

SEQ ID NO: 2249618 - RNA, 78 nt, Homo sapiens
cacagggcuaucccagaaacucggguuucucuugagaugccagcugagacucccgucuucucuguggaaagcccugug

SEQ ID NO: 2249619 - RNA, 107 nt, Homo sapiens
agccagauuauuuauuuaacaauacuuaauuauugcuuacccuguauuagaucucuauagguagugaugaaauaguggugaacaaagaguuaggaugguaucuggcu

SEQ ID NO: 2249620 - RNA, 87 nt, Homo sapiens
uuggcccagcuuggcucaugugaccaucucuccacuaaucauggaaccucugauuggccagaccauggucaggugucccacagucag

SEQ ID NO: 2249621 - RNA, 69 nt, Homo sapiens
uucaggcugauaaaugacaguaauuguucuuaaguugaagagcugguuuaauaugcugucuggccuggg

SEQ ID NO: 2249622 - RNA, 83 nt, Homo sapiens
cugaagugauagcauuaagcuagcauagggguaaauuaaugaguauauuaauuuagaauucgcuagcuaaugucucauuucag

SEQ ID NO: 2249623 - RNA, 88 nt, Homo sapiens
cuguacucugaacuuguaacguaaugucaaaaucuauuguuuauaauaaaagaacuggcuuuauguuauuuuguuucugagaaugcag

SEQ ID NO: 2249624 - RNA, 79 nt, Homo sapiens
aggcuggagugcaguggugugaucucggcucacugcaagcuccuccucuuggguucacaccauucuucuacuucagccu

SEQ ID NO: 2249625 - RNA, 95 nt, Homo sapiens
ggggagacagaguucauggcuuugaagugagacacauucggguucacauccuagcccuugcacuucagagcugcauagcuugggucugucuuccc

SEQ ID NO: 2249626 - RNA, 75 nt, Homo sapiens
ugggggcaggcaaggugaaguguacugggaugaggugccucucccagacccuggugcuuuccuggcucuccccca

SEQ ID NO: 2249627 - RNA, 80 nt, Homo sapiens
cacagggguccccggaugacggccgcuucacacaggggcccccgacugacggcugcaucacccggggcagaccuacugug

SEQ ID NO: 2249628 - RNA, 80 nt, Homo sapiens
ucuguuuuugggugggauggcagaacugguugggccagauuacugguguggguagugucagcugauccauccagugcagg

SEQ ID NO: 2249629 - RNA, 105 nt, Homo sapiens
gauuguuuugaaaugugaggacaugggacuuggggguggccaagggugaaaugauaugguuuggcucugugucccacccaaauuucaccuugaauuuuaauaauc

SEQ ID NO: 2249630 - RNA, 60 nt, Homo sapiens
ugacucuggcaggcucggggaccaguucuacaaggaagccauugagcacugccggaguua

SEQ ID NO: 2249631 - RNA, 65 nt, Homo sapiens
uacacccacugugacauuagaaguaacaucccccuagggcaugaugaauaauaucacaaggugua

SEQ ID NO: 2249632 - RNA, 86 nt, Homo sapiens
uggugauagauagauuugggacagauccugacuccuuacuuggcucuaaggccuuaggcuaguuucuuaaacucucuggaucacca

SEQ ID NO: 2249633 - RNA, 84 nt, Homo sapiens
ggcccacccuguugagcaacuggccaucccaguggcacauauugagccuggugggggguggugcaguuucaaugggguuggguc

SEQ ID NO: 2249634 - RNA, 81 nt, Homo sapiens
aggacccuuucagauugaagaguugaggggcucuggagcagggaccccauuugaacuccuucaacugccuugccugguccu

SEQ ID NO: 2249635 - RNA, 95 nt, Homo sapiens
guuugaggcugcagugaguuaugauggcaccacugcacuccaaucuggggagcugcagugcaauggugccaucauagcucacugcagccucgaac

SEQ ID NO: 2249636 - RNA, 62 nt, Homo sapiens
cuguccacuuuugugcugaauuggagccucucuuugaccucuuucuagcauagaaauggcag

SEQ ID NO: 2249637 - RNA, 77 nt, Homo sapiens
augaagcucuucaaagacacacaaggagaagguucuaacacaugggccugaugaauuauguguuuuugaugacucau

SEQ ID NO: 2249638 - RNA, 95 nt, Homo sapiens
guugcagagaucuuugacgugucuccucaguaggccuuuuguagcucuagcucagaucaugcuuaugaugggacaacaucacuugguccugcaau

SEQ ID NO: 2249639 - RNA, 55 nt, Homo sapiens
gaggcagagcuugcaguaagccgagaucgcgccacugcacuccagacucugucuc

SEQ ID NO: 2249640 - RNA, 87 nt, Homo sapiens
ggccucauuuacgugccgaugucuagagcaagagaugcuggaaaagaaguaucuagaauuuucugcuuugauaguaggagaggggcu

SEQ ID NO: 2249641 - RNA, 71 nt, Homo sapiens
ucagcaacauaaacaacauagauucagugauaugguuucuguucauuggacuuguguucuugagggccuga

SEQ ID NO: 2249642 - RNA, 90 nt, Homo sapiens
gugaucggaggagcugccaugaagaucccugaaaugcucuggagguauauucuacauuuucuuggcuauuaacauucagcuccuuguuac

SEQ ID NO: 2249643 - RNA, 80 nt, Homo sapiens
uugcuugaacucggaagcggagguugcagugagcggagaucgugccacugcacuccagcuccagggugguaauagagcaa

SEQ ID NO: 2249644 - RNA, 61 nt, Homo sapiens
ggcaaaacagaagaggcuuguagccaagcuacuuaggucuacagugccugucucuuuggcc

SEQ ID NO: 2249645 - RNA, 55 nt, Homo sapiens
ccuggguuccacuuuuaacgaauuaaaucagaauuucuugggaauguagccuagg

SEQ ID NO: 2249646 - RNA, 71 nt, Homo sapiens
aggaugcagucaggaagcuaaccaaaacccaccaaaaccaagagggugaggaaagcaucacugaucauccu

SEQ ID NO: 2249647 - RNA, 56 nt, Homo sapiens
caguugggaagacuuggagguuuaaacaaaaaguaauaucaccagucuuuccacug

SEQ ID NO: 2249648 - RNA, 89 nt, Homo sapiens
uugaugaauaacugugacaauuguuguugcauuuuuaaacauacacaaaaagugaggccagcaacauugagacugcaguuggauaucaa

SEQ ID NO: 2249649 - RNA, 80 nt, Homo sapiens
ucuggcucugggcuaaagaaauacauaugggagucaucauaguaucgauauuuuucuucaggguccacuccagagacaga

SEQ ID NO: 2249650 - RNA, 63 nt, Homo sapiens
gaggucagauuuccuugcaguuuggaacuuccuuggaauuccauaguacuagaaacugaccuu

SEQ ID NO: 2249651 - RNA, 56 nt, Homo sapiens
uguaggagcaaugcugauuuaguguggcccaugcuguacagauagaauguucuaca

SEQ ID NO: 2249652 - RNA, 69 nt, Homo sapiens
cccacauaaauguucuggcucuuccaaggaccccagcaggcaucuuucauagcagaacaaauguguggg

SEQ ID NO: 2249653 - RNA, 62 nt, Homo sapiens
uuucugcugugcuuucuugcguauuuucuuaauggauagauaggacaaugguacagcagaaa

SEQ ID NO: 2249654 - RNA, 89 nt, Homo sapiens
gugucugguuugugcauauaaguuguuucuaguuuuugcuggaacuaaaacugcagcagaaacauacuugcauguacauuuuggugcau

SEQ ID NO: 2249655 - RNA, 83 nt, Homo sapiens
uggucagacuugucuagaacuucugaccuuaggugagccgcucaccuaagucaccuaagugcuaggauuacaggcaugagcca

SEQ ID NO: 2249656 - RNA, 62 nt, Homo sapiens
ucagcaauuccagccagggguuuacaaacagaacucugauaucacugggauggaacugcuga

SEQ ID NO: 2249657 - RNA, 105 nt, Homo sapiens
gaggaaaagaaguucaacaucaagguauuggcagaauugguuucuucuaaggccucucuggcuuggagauggccauuuucuuguaucuucaugugaucuuuccuc

SEQ ID NO: 2249658 - RNA, 79 nt, Homo sapiens
uuuugggauagguagguaguuacacagcaauguaucuggaacauacacaucuggugugacugccagccccuuaccgaga

SEQ ID NO: 2249659 - RNA, 78 nt, Homo sapiens
gacuccaguacagugcauggcacugagcagguaugcaaccauuuuuguugcaugagcgaauguguccuguacagaguu

SEQ ID NO: 2249660 - RNA, 74 nt, Homo sapiens
uguggcuaguggaauuaagaaacugaauuuuaaauuguauuuaguuuuaauucauuuaaauuucaauagccacg

SEQ ID NO: 2249661 - RNA, 87 nt, Homo sapiens
caaugcuaguuuuuaagaaaugaguuucuagccuuccagauugaaauacuuggaaggucauuguucauuugauaaagguaggcauug

SEQ ID NO: 2249662 - RNA, 67 nt, Homo sapiens
aagaagacaaacccacuggcuuuguuuaugaacauuuauugacauuacagugggucuugucauuuuu

SEQ ID NO: 2249663 - RNA, 74 nt, Homo sapiens
gcccucacugauuaaacaaggagaccaaguagugacuuggucucuuugcuuuagucaucacauagcguaugggc

SEQ ID NO: 2249664 - RNA, 67 nt, Homo sapiens
gcagcagcauggguauaaaucuccaccccucagauggggacugcagauucaaaccaugacuugcugu

SEQ ID NO: 2249665 - RNA, 63 nt, Homo sapiens
gaucacauggccagguaguaaucaguuucacacucaggcagaugaacugcagggccugugguc

SEQ ID NO: 2249666 - RNA, 73 nt, Homo sapiens
cccaaacuggagcguggguccaaggcucugguucuaucccagggaucaaagcagcauggcccaguccaauggg

SEQ ID NO: 2249667 - RNA, 67 nt, Homo sapiens
gcauaaucuacuugacugaguacaggagaguaacaauagucuucauagucuaugcaaguaagagugc

SEQ ID NO: 2249668 - RNA, 79 nt, Homo sapiens
gccuuccagaugaucugucacuuaucacauuuaaguuuguagauggauuagaugcugauugaauagauuucugaaaggc

SEQ ID NO: 2249669 - RNA, 76 nt, Homo sapiens
uguguaaaugagugcugaaggagcugugaaauucugaauaauacucauuugucuuugcuccucagcacuuaauaca

SEQ ID NO: 2249670 - RNA, 58 nt, Homo sapiens
guaugucaaggugggugauaguuuuagacccuucuaaaaauucaagacugugacauau

SEQ ID NO: 2249671 - RNA, 126 nt, Homo sapiens
gcuucagcccaggaguucgagaccagacuaggcaacauggugaaacucugucucuauaaaaaauauaaaaauuagcuaggcauagugccgugugccuacaguccuagcuacuugggaggcugaggu

SEQ ID NO: 2249672 - RNA, 60 nt, Homo sapiens
agcccuuagauggcuccuuccauuucuuucucaaucuggcccaaagucauuugcagggcu

SEQ ID NO: 2249673 - RNA, 92 nt, Homo sapiens
cagugagguugaauacacuuuguacuggcuuguuucagagaggaaacucuaaccucuuuggcauuagccuguauagaacucaccccuuacug

SEQ ID NO: 2249674 - RNA, 78 nt, Homo sapiens
ccugcagguaguuucugacuuuuacauaacuggcuucuucuaugaaagccaaguagagacucaagaaacuacagcagg

SEQ ID NO: 2249675 - RNA, 67 nt, Homo sapiens
uagguagugugugcaugagaggcagaggaucugaguaacccuggccuuauuucuugcacauaaucua

SEQ ID NO: 2249676 - RNA, 69 nt, Homo sapiens
gagcccagcgaggcgugaucaguuugaggucagagguguugaauagacagucacugccuccccuggcuc

SEQ ID NO: 2249677 - RNA, 103 nt, Homo sapiens
uguacuuaauauuauuagguuggugccaaaguaauugcaguuuuugcaauuauuuuuaauggcaaaacagcaauuacuuuggcaccaaccuaauauuaguaca

SEQ ID NO: 2249678 - RNA, 77 nt, Homo sapiens
cuccuuaaaguguuuguuauuaaagguucugcaguugggcgugguagcucacaccuguaaucccagcacuuugggag

SEQ ID NO: 2249679 - RNA, 63 nt, Homo sapiens
ugucaguuucuugagauggaacgcacuccugcugaagaugcugugaccaucuuugagaugaca

SEQ ID NO: 2249680 - RNA, 76 nt, Homo sapiens
guucauuucuggaaguuuuuauuuaauauucucaaacugagguugacugugguaauggaagcugcagaaagugaac

SEQ ID NO: 2249681 - RNA, 85 nt, Homo sapiens
ggcuguggggguugaaaggaagugguguaucaagcaaaugagcuacagcugugaugguuuagcauuuucuuugaaacauauggcu

SEQ ID NO: 2249682 - RNA, 57 nt, Homo sapiens
uggaugccuaauaaaugcagacuugaauugaauuccauuguauuuauaggucauuca

SEQ ID NO: 2249683 - RNA, 89 nt, Homo sapiens
uuaaagcuguaaacuuuccccaagugaauguuugguagcaguguucuaucucugcgaccacuaugcccuguucacuuuuacgguuuuaa

SEQ ID NO: 2249684 - RNA, 104 nt, Homo sapiens
gcuaguaaaauaaacaccccgauucucauuugugugcaauucagaauauuacccagauguugggaugaauacaaugggaucaucugugggaaaagcacauuagc

SEQ ID NO: 2249685 - RNA, 79 nt, Homo sapiens
ccuggaaggcuggcagcccugggcagagggauugguucacuacugagccccauccccugcacggggugucauucuuagg

SEQ ID NO: 2249686 - RNA, 67 nt, Homo sapiens
cacccucgcuccauuucggugaucaauucauccacugaauggacauuuggggguggagcgaguggug

SEQ ID NO: 2249687 - RNA, 76 nt, Homo sapiens
aggaugagguagaauguuuuucagcugacaaaacauauuguuagcuggaaaacuaacauucuacuucauguggccu

SEQ ID NO: 2249688 - RNA, 57 nt, Homo sapiens
gguaggagaauggcuugaacucagcaagcagaggcugcagugagccaagauccuacc

SEQ ID NO: 2249689 - RNA, 76 nt, Homo sapiens
uuuucauagugaaaaauucaaaguucaaggggaucuuacaaaucauuucugcaaacuuugcuuucacauaugagga

SEQ ID NO: 2249690 - RNA, 72 nt, Homo sapiens
gggauaggaacuuugaaagucauuucuucuaaguagcaaagcugcuuguugaauugcauuuuccauuaucuu

SEQ ID NO: 2249691 - RNA, 64 nt, Homo sapiens
aacagaaagaggaugcagaucucauuuuuauuuggaggaugcagaucacauuuuucugucuguu

SEQ ID NO: 2249692 - RNA, 60 nt, Homo sapiens
gugagccaaguucacaccauugcacuccagucuggaugacagagugagaccuugucuuac

SEQ ID NO: 2249693 - RNA, 74 nt, Homo sapiens
cugaguguuggagcagggacuuugccugggugaugcugcugggcgggaccacagugcuuccugcucacgcucag

SEQ ID NO: 2249694 - RNA, 89 nt, Homo sapiens
guguaugacagcuaaauuguuaaauccaaggucaugaagcuuuauccuuauguuuucuucuaaggguuucacagguuuagcucuuacau

SEQ ID NO: 2249695 - RNA, 77 nt, Homo sapiens
ugcacacagagagaaagagagaucaugugccucccuugcuuaaaacccuacaccaucuccuuauuucucuugcggca

SEQ ID NO: 2249696 - RNA, 58 nt, Homo sapiens
uguuacguuuacaauacauuucaacauauuauauguugacuguggguacaaugugaua

SEQ ID NO: 2249697 - RNA, 100 nt, Homo sapiens
gaggugggagaaucucuugaacccuggaggcggagguugcggugagcugagauuccgccauugcacuccagccucggcaacaggagugaaacucccucuc

SEQ ID NO: 2249698 - RNA, 79 nt, Homo sapiens
aagcaaauauacccuguaguuagaaacuuucaacugaacauguuagagaccaaguuuaacuucaggcaugcauuuguuu

SEQ ID NO: 2249699 - RNA, 70 nt, Homo sapiens
cauagccaugcacaugcgaaaacuugugugcauuugcacacuugauuuccuuugcaugugcauggccaug

SEQ ID NO: 2249700 - RNA, 80 nt, Homo sapiens
gggauuaaugaguacccagggaaugugggaugacucuaggcuggagcuggggucauuaaauuccgcuggucauuaauccc

SEQ ID NO: 2249701 - RNA, 84 nt, Homo sapiens
auauccuuugcccauuuuuaaugggguuguuuguuuuuguguguguauauaaauucauuuaagcuccuuauagaugauggauau

SEQ ID NO: 2249702 - RNA, 57 nt, Homo sapiens
uuugcuucuuucgucuggccccaggccugguucccugggggacagggaagaagcaag

SEQ ID NO: 2249703 - RNA, 80 nt, Homo sapiens
ggagaaggagaaaggauuguguagucuuacugcuugcauuuauucaaaugcaagggggagcuaccagccuucccuccucc

SEQ ID NO: 2249704 - RNA, 92 nt, Homo sapiens
ggggggaaaacacguuuguguaauuuuucaggcugugagaaagcaauuauuuucuuuggucagaaagauuacacucgauaguuuuucacucc

SEQ ID NO: 2249705 - RNA, 70 nt, Homo sapiens
ucccccuucccagcuguguugucugaagucagaggcucuacuccugaguagucauuacagccaaggggga

SEQ ID NO: 2249706 - RNA, 65 nt, Homo sapiens
aggaagugugcaauuaauuucuauuuaccaucccuucuucucuagaaaaauugauaucgcuuccu

SEQ ID NO: 2249707 - RNA, 64 nt, Homo sapiens
caaggaugucaguguaugagccccggaugagaacaccuggggcaggugccacuggcuggccuug

SEQ ID NO: 2249708 - RNA, 55 nt, Homo sapiens
gcccaguucaaggcugcagugagcuaugaucacgcugcugcacuuaagcaugggc

SEQ ID NO: 2249709 - RNA, 81 nt, Homo sapiens
ggaaauaaugacucuguucaguaguucauucauuuauucaugugauaaauauugacugacugcuuaacaguauguuguucu

SEQ ID NO: 2249710 - RNA, 68 nt, Homo sapiens
gucauuuggaagguagggacuagaaugaggaccucaggacucugcauggugcccuguccuucuguggc

SEQ ID NO: 2249711 - RNA, 62 nt, Homo sapiens
ucuuuucuaugaucauuauguuauugcagcuuucugcuggugauauugugauuauaacaaga

SEQ ID NO: 2249712 - RNA, 65 nt, Homo sapiens
aaauauuggcacugagcaagaacagggcacugaagaggauucugagcuuucuaguguagauguuu

SEQ ID NO: 2249713 - RNA, 86 nt, Homo sapiens
uaaguuuuaggguacauguguacaacgugcaguuuuguuacauauguauacaagugccauguuggugugcugcacccauuaacuug

SEQ ID NO: 2249714 - RNA, 88 nt, Homo sapiens
ggagaauugcuugaacccggcaggcggaggcugcaguaagccaagaucaugccauugcacuccagucuggggggcaaagcgagacuuc

SEQ ID NO: 2249715 - RNA, 84 nt, Homo sapiens
aaagccuuucuggccgguauuugccucugggggcugcaucaucgucuacccagaguucuuaaauacugagcaacuuaagguuuu

SEQ ID NO: 2249716 - RNA, 62 nt, Homo sapiens
uaugcuguuuuguagcucccucuuuucacuaacccacuacaagauggggcaagaagagcaua

SEQ ID NO: 2249717 - RNA, 58 nt, Homo sapiens
ugcaaugggaaaaucagaaggccugggggccccagaccuagauuuuacucagcuugca

SEQ ID NO: 2249718 - RNA, 58 nt, Homo sapiens
cuggagcacagcagggccagcugccccacgagcucgggugcucaccuugcugcuccag

SEQ ID NO: 2249719 - RNA, 95 nt, Homo sapiens
agugcuugucuauuuacugcuuguuauguuggucaguaaugugugacgugcuucauuaauauuauuugucuaaaauaaucccagagauaaguauu

SEQ ID NO: 2249720 - RNA, 57 nt, Homo sapiens
gggcggugccugucuccgaagcgaggagcggauuggcuucacggaggccgcgccccc

SEQ ID NO: 2249721 - RNA, 55 nt, Homo sapiens
cauuuacuggauacccaccauguaucagacacugcugguguuugaacagugaaug

SEQ ID NO: 2249722 - RNA, 55 nt, Homo sapiens
uguagucauuuggaguccagcucuuuuccugcugggcaccuauguaugauucaca

SEQ ID NO: 2249723 - RNA, 55 nt, Homo sapiens
ugucaaauugacaaaggguaaaccccaguggauuuguacuaugucaguuuagaua

SEQ ID NO: 2249724 - RNA, 70 nt, Homo sapiens
caggcucauagcugccaugagcuaugauugcaauggugcuaucauagcucacugcagccucgaccuccug

SEQ ID NO: 2249725 - RNA, 55 nt, Homo sapiens
cuuuucuugugauucagcaaguaggaaacacucuuuuugcagaaucuaagaagag

SEQ ID NO: 2249726 - RNA, 80 nt, Homo sapiens
uaggagaaaagcuaguccuauacccuaggacuaaggcuucagucuaagacuaagggcuagcuucaaacaaauuuucccua

SEQ ID NO: 2249727 - RNA, 55 nt, Homo sapiens
acucaaggugaauguuacucaguaaucaauguugagcaauauucuacuauugagu

SEQ ID NO: 2249728 - RNA, 91 nt, Homo sapiens
uaaauugugaacacucucuuaauuaguaaacauuuuucuaucauuguguaaauguacaaaguguuucauuguguggaagggucaccauuua

SEQ ID NO: 2249729 - RNA, 106 nt, Homo sapiens
augaaugaaccuugaggacauuaugcuaaguggaauaagccagucacacaaagauaaauacuguaugauuccacuuagacaaagugucuagaguagucaaauucau

SEQ ID NO: 2249730 - RNA, 56 nt, Homo sapiens
gcuguuugagagaacuucuccagauggcuucuagcugguuuauuucucacaacagc

SEQ ID NO: 2249731 - RNA, 129 nt, Homo sapiens
gggcucuggccuauguugggcucucauaaucauagguagcauagcaggaauauuagugauagguuguugcucccuauauuguugcugugaccugugaguucagggugcugcccuauguacacagauccu

SEQ ID NO: 2249732 - RNA, 82 nt, Homo sapiens
caugucauuaucagcagcaugaaaacggacuaauacaguaaauugguagcaguagaguggaguguugcugaaaauguaccug

SEQ ID NO: 2249733 - RNA, 75 nt, Homo sapiens
uauagauuaauuaugagaagucaauuguuguuauuaacuaauaauaauguuaggcuuacucaaaaguugucuaug

SEQ ID NO: 2249734 - RNA, 65 nt, Homo sapiens
caguguugaggucuucaggaucaggcucugggucuucagaaaccggguccagaucuucaggauug

SEQ ID NO: 2249735 - RNA, 59 nt, Homo sapiens
acuccauuuggaacagauguccugcccuucaucucuccagggccuuggccagauggggu

SEQ ID NO: 2249736 - RNA, 87 nt, Homo sapiens
gagauuggaaagcccuuuaaaguaugauauagaagucauaaacaauaugacuauaggauaacaugcauuuuuaaguuuuucaaucuu

SEQ ID NO: 2249737 - RNA, 60 nt, Homo sapiens
cauggucaccuuccaaguuauuggggguuaaaacuucagggcugggcgugguggcucaug

SEQ ID NO: 2249738 - RNA, 88 nt, Homo sapiens
cacgccugcggggggcaugugugugcacacacaugugcacuuuugugugugugugcauguacacaguugugccccugcacuucgcgug

SEQ ID NO: 2249739 - RNA, 64 nt, Homo sapiens
agucuuacaauauauguuugugugugugugucugccuacuuucauuuagcauguguuugagauu

SEQ ID NO: 2249740 - RNA, 72 nt, Homo sapiens
ucugauccugauuuguccccagccucauguuuccccauggaaaucugauauugugggacaguaucuauuaga

SEQ ID NO: 2249741 - RNA, 66 nt, Homo sapiens
ucucauucuccauccaguuuugcacccuugcuggagaggaguugcaaucauuuggaggagaagaga

SEQ ID NO: 2249742 - RNA, 63 nt, Homo sapiens
gucagugucugugcaccgcuggaagcucgguuggcugacuccugggccgugcuuggaccugac

SEQ ID NO: 2249743 - RNA, 80 nt, Homo sapiens
ugaucaaacccuugcugaggauuuggccauugacaugggcuucugguuaaucaggccguuuccuaagaagagucagguca

SEQ ID NO: 2249744 - RNA, 64 nt, Homo sapiens
uuacucugugcaggggcaugcaguguacuuuaggauacaaaguaacaguuccuguauucaguaa

SEQ ID NO: 2249745 - RNA, 93 nt, Homo sapiens
ucuauuucuuugucucuguacaguggguguagggaccagccccacagggucggcggguuuuucuccccauguguggagacaagagauuguaga

SEQ ID NO: 2249746 - RNA, 96 nt, Homo sapiens
ucugcugggagaauggaucuucccuugcaggaugaucuggacaacacaucacaggguccaucaaaaggguaaaggaaaucuguucuuguauuuaga

SEQ ID NO: 2249747 - RNA, 58 nt, Homo sapiens
cagggguagauggucagcacacauccauaccugcugguggcugugaucaucacccuug

SEQ ID NO: 2249748 - RNA, 75 nt, Homo sapiens
gguuggcgcagaagaaauuguguuuuuuugccauugaaaguaauggcaagaaccacaauuacuuuugcaccaacc

SEQ ID NO: 2249749 - RNA, 84 nt, Homo sapiens
ccugaagucuuuugaugaucucuggugguaaagacccuuguuucaaagucuuauuuaaagagaucauacuuccaagcacuuagg

SEQ ID NO: 2249750 - RNA, 69 nt, Homo sapiens
auuuagcagcagugguguauuuagauacuuccccacuuguggaagucugauuagcuccauuugcuaagu

SEQ ID NO: 2249751 - RNA, 101 nt, Homo sapiens
guggcacauggaaugccagugagacagaaccauucacuccccuggaaaggcgucuaaagccagggagccaaguggucuagcucagcguaucccacccccac

SEQ ID NO: 2249752 - RNA, 57 nt, Homo sapiens
ucauggggugagcuacaggcacacggggcacaagugcagucugaguggcaccuguga

SEQ ID NO: 2249753 - RNA, 80 nt, Homo sapiens
cacccuccugacuuccuugguugauccugugcagaagucgauagcuuaucuccacgcagcaaccagaaagugagauggug

SEQ ID NO: 2249754 - RNA, 81 nt, Homo sapiens
gagaucugcuguguaacaauguguauauuaguuaacaauucuguacaguaugcuuuaaacuuuguuaagaagguagauuuc

SEQ ID NO: 2249755 - RNA, 122 nt, Homo sapiens
cccgcccccaucccgcccgcgcaagguuuuuggcguucacaccuacuagggccgugggcuugugccaagacccacggaaagaggugggaggugggaagugggaggugggcgguggggguggg

SEQ ID NO: 2249756 - RNA, 60 nt, Homo sapiens
gaaucauugagagacugagcuauauaauacuuguauagagcugugucuucuuaaagauuu

SEQ ID NO: 2249757 - RNA, 83 nt, Homo sapiens
agaacagagagguucagucacgugcccaaguucacccaggcugguugugaacuucagcagcguggcuccaaaguccauguucu

SEQ ID NO: 2249758 - RNA, 74 nt, Homo sapiens
auguuuuggcauaguugcacuuacuagaaaaucugaauccaaugugcuaguuuguguaacuaugcauuaaucau

SEQ ID NO: 2249759 - RNA, 66 nt, Homo sapiens
gaugaaacuucccagggagcagcccucagaaagaauagaugguagccuguggugaauguuucuguc

SEQ ID NO: 2249760 - RNA, 55 nt, Homo sapiens
uauguucaucuugugcucaguaaauuugcacuuugccuaguagaaggugaacaug

SEQ ID NO: 2249761 - RNA, 74 nt, Homo sapiens
ucgcuauaucacccaggcuagagugcaguggcaugaucauagcuuacugcagucagacuccugggcuccagcga

SEQ ID NO: 2249762 - RNA, 80 nt, Homo sapiens
gucucauugagugcugagcccacuuccuugcacacuccuccguggucccaggaaggauucggcauuucuaaacuggagac

SEQ ID NO: 2249763 - RNA, 77 nt, Homo sapiens
ucuucagcagugguuuuaaguagagcauacuaaagcaauaguagugugcaggauuuugaugccaucuccgcugaagg

SEQ ID NO: 2249764 - RNA, 55 nt, Homo sapiens
agguauuuagucuuguguccuauccuuucuuuuuaggauaguagauuaaauauuu

SEQ ID NO: 2249765 - RNA, 65 nt, Homo sapiens
cauuuacauaguguguggguucggggggagacugguugccccacccuaaucuuauuaugcaaaug

SEQ ID NO: 2249766 - RNA, 55 nt, Homo sapiens
gaugaguauauuguauucauuauauugguuagauggugaguauauuguauucauu

SEQ ID NO: 2249767 - RNA, 100 nt, Homo sapiens
gaggcagaagaauugcuugaaccugggaggcggaguuugcagugagcugaaaucuugccauugcacuccagccuugggcaacagagcaagacucugucuc

SEQ ID NO: 2249768 - RNA, 89 nt, Homo sapiens
guguuaauuaugguaaauugaugaugauagacauuuguuuagcugacagagccacugagcaaaguucuauuuauggucagggaagauac

SEQ ID NO: 2249769 - RNA, 81 nt, Homo sapiens
gguaucuuuauagcaguaucccaccaucugguagcaauuuacuguauuaguccguucucaugcugcuaauaaagacauacc

SEQ ID NO: 2249770 - RNA, 97 nt, Homo sapiens
ugauuguuuuuuguguauguugggagucacugguaaguuucacucuuuugcguacgauauccaguuuucccagcaccauuaauugaagaaacuguca

SEQ ID NO: 2249771 - RNA, 84 nt, Homo sapiens
accuuugaauuauucugauuuuugcauggcuuucaagcugaaccuuguaaaugaauaguuugacagaacucuuuaaugaagggu

SEQ ID NO: 2249772 - RNA, 106 nt, Homo sapiens
aaaagcacaagagauagacgucacccuggagagugcuguaguaaucccuaaaugccuuauaggauuacugaacccuacuuuuacagguucuuucuguuguucuuuu

SEQ ID NO: 2249773 - RNA, 62 nt, Homo sapiens
uuauuucccuugcaucugaccauaaauucacaagaauuaugacuuucagcuaggggauauga

SEQ ID NO: 2249774 - RNA, 118 nt, Homo sapiens
ucagaucagcagcggcauuagauucucauaggagcagaaaccguauuuugaaauguucaggggagggauguagguugugugcuccuuaugagaauccgacuaacgccugaugaucuga

SEQ ID NO: 2249775 - RNA, 63 nt, Homo sapiens
ugacaugauguuccuacacugugccuaucaacacuuguagacacacuguauaagcguuuguua

SEQ ID NO: 2249776 - RNA, 67 nt, Homo sapiens
auagagccacacucuccuaacucauagcagugaccucagcauugagauuaggggugugugucugugu

SEQ ID NO: 2249777 - RNA, 65 nt, Homo sapiens
gaaugccugagaggauaugauccccuugaagcugauuacaggguagacauacaucucagccauuc

SEQ ID NO: 2249778 - RNA, 69 nt, Homo sapiens
gacuuugcugagucauuccaugcugugucaugaaacucugugcugcugcaggagacucagaagaagcuc

SEQ ID NO: 2249779 - RNA, 72 nt, Homo sapiens
uuaauaaguagcuuauauaugcauguguaugugcauaaugcaguagaauguauguauaacgcaagagauuaa

SEQ ID NO: 2249780 - RNA, 58 nt, Homo sapiens
ugagacggagucuugcuaaguuacccaggcuggagugcuguggcgcgaucucugcuca

SEQ ID NO: 2249781 - RNA, 56 nt, Homo sapiens
uuauaauccaaacuuacugggcguugucuacaaauuguccagcuuuuggaauauaa

SEQ ID NO: 2249782 - RNA, 89 nt, Homo sapiens
ggagaaucgcuugaagccgggaggcggagguugcagugagccaagauugugccacugcacuccggccugggcaacaagagcgagacucc

SEQ ID NO: 2249783 - RNA, 114 nt, Homo sapiens
auguagaaauaagcauuguuaauauuauguuguauuuccuugcagucuuuguucuaaaugcucauaguugcacagaaugacaauauguacauguuuuuaauguuguauuuauau

SEQ ID NO: 2249784 - RNA, 87 nt, Homo sapiens
ugcacggguguguguacugcaugggugcaugcugcuugggugugugugggcagcauugccuuugcagugagugcagaccucugugua

SEQ ID NO: 2249785 - RNA, 61 nt, Homo sapiens
ucucauggcauggucaacuggaagguauuccauugguuaucauagcuaugcuacuaggaga

SEQ ID NO: 2249786 - RNA, 56 nt, Homo sapiens
ccucucuugaaagacuccuuuggugaccagugggucacaguccuguuuaggagagg

SEQ ID NO: 2249787 - RNA, 103 nt, Homo sapiens
uuggcaaaugaaugagucauccugagccucuguccucacaucuguaagagggagcccuaauaguagguguugguagagguuucguggcaaccucgugagcuga

SEQ ID NO: 2249788 - RNA, 58 nt, Homo sapiens
gaaaaucccagcagcuauguaugggaugguuacaccagacacugugcuaaggauuuuc

SEQ ID NO: 2249789 - RNA, 62 nt, Homo sapiens
uguuugggggaaauuaucacuuggagucauuucauaaaucaacugugauauuuucccagaua

SEQ ID NO: 2249790 - RNA, 94 nt, Homo sapiens
uaaaugucauuucuuuaaggaucaaaagugugaauaauaaguaaauauguuuuuucaagcuauggugaucuuuuccaagggauggugauauuua

SEQ ID NO: 2249791 - RNA, 119 nt, Homo sapiens
uaauuuuaggcuucugaucuccagaauuguaauaaaacaaauguauauauuuuuugagccacugaguuuguacuaauuuguuguagcagcaauaggaaauuaacauagccucaaaauua

SEQ ID NO: 2249792 - RNA, 75 nt, Homo sapiens
uuguuuuguuuugagauggagucucacucugccacccaggcuggaaugcaguggugccaucucagcucaccacaa

SEQ ID NO: 2249793 - RNA, 92 nt, Homo sapiens
acacuauuaaauauuuggaaaauuagcaagaugaauuugugcaaacaguuauauauaguucuguuuguucuuauuuuuuauauauguggugu

SEQ ID NO: 2249794 - RNA, 74 nt, Homo sapiens
ccugcacuucuuucucuguguuauucauaagauaugagagucuugagucugagaugaugggauaagagggcagg

SEQ ID NO: 2249795 - RNA, 112 nt, Homo sapiens
gccaaggacaugagcaaccacagaccugugcauaugcaugugcaugcacguggaccuucacgccgugugcaugcuuuuguaugucuacaggcuuuuuggagaugugccuggc

SEQ ID NO: 2249796 - RNA, 85 nt, Homo sapiens
uuguagccagggaccccugacucauuaggacucaagacaccuaccugguuucauagccuucuaaugaguugucgccggguugcaa

SEQ ID NO: 2249797 - RNA, 56 nt, Homo sapiens
uacagcugcaauaaugccagauacuuuaucaggcaucugguauuacugcaacugua

SEQ ID NO: 2249798 - RNA, 81 nt, Homo sapiens
uaaauuuauauauguuuucugggaagaaaagcuauuuuacaauauuaagucuuucuaucugagaagauaucuauuuguuua

SEQ ID NO: 2249799 - RNA, 71 nt, Homo sapiens
ucacuucgagccauagccaguauuuugaguuggucuagugagaucaccuguaauagugguugcuaauguga

SEQ ID NO: 2249800 - RNA, 93 nt, Homo sapiens
gcagguguccuuaaguagggagaggcaggcaaccaccugggaagauguuaaaugcacacauccccggguucugucugcccuuggagauucugc

SEQ ID NO: 2249801 - RNA, 65 nt, Homo sapiens
ggguacaugugcacaacaugcagguuaguuacauauguauacauguggcauguugguaugcaccc

SEQ ID NO: 2249802 - RNA, 66 nt, Homo sapiens
uuacccaguaacaaguauuuuggaccaugcauagacuauuuuccaaaacuacugguuacuguguga

SEQ ID NO: 2249803 - RNA, 65 nt, Homo sapiens
ugaagagagcagugguucucccagcauggcauucaagcucugagaaugaacagacugccucuuca

SEQ ID NO: 2249804 - RNA, 72 nt, Homo sapiens
ugauucauuugccuuuagucacuaauauauuaauuccagaaaaguaagauaaugacaaggugcaaagaauca

SEQ ID NO: 2249805 - RNA, 77 nt, Homo sapiens
gggguagcccauguggcugaggcuucuagacacauuucaccucucaugggucagagacagacacaucgggcugcucu

SEQ ID NO: 2249806 - RNA, 71 nt, Homo sapiens
ucuuuauagcagugccccaaacuccugguaccaauuuccuguauuagucuguuuucacguugcuauaagga

SEQ ID NO: 2249807 - RNA, 86 nt, Homo sapiens
gaggcacugcaaagucgaaacugcaguuuaggcuguaauuaaaucauccaggagacuaggcuucagguuugcuuugcagaaaucuc

SEQ ID NO: 2249808 - RNA, 58 nt, Homo sapiens
ugagugcuggcuguagugacugggcagauuaucauuaggucacuggacagcacacuca

SEQ ID NO: 2249809 - RNA, 57 nt, Homo sapiens
auaauucuucuuuugagaagucugaaaaaaaggauguucuucaggcagaaggauuau

SEQ ID NO: 2249810 - RNA, 59 nt, Homo sapiens
uagguuguucucaugauuagaccaauauaauguaucuaaugcucugagaacagugccug

SEQ ID NO: 2249811 - RNA, 55 nt, Homo sapiens
aauguucuguauguuuuccccuagaaauuuucuuggggaaucguaauagaauauu

SEQ ID NO: 2249812 - RNA, 61 nt, Homo sapiens
uggcgagcugaaauuauaaaaguuaucuaggauuccugucuuuuauuguuucagccaguca

SEQ ID NO: 2249813 - RNA, 82 nt, Homo sapiens
ggucaggccagaggccccuugcucuccaaauccuuagagagccuccucccugacauucggagauguaguucuggcuuugacc

SEQ ID NO: 2249814 - RNA, 75 nt, Homo sapiens
auaggaccuagaauuuaaguggaagcagcgugguagaguacaaauagcuucugacucuggagucucagguucuau

SEQ ID NO: 2249815 - RNA, 56 nt, Homo sapiens
ugaaucaugcugcuauaaagacacacgcacacguauguuuauugcagcauuauuca

SEQ ID NO: 2249816 - RNA, 106 nt, Homo sapiens
ccuuugaauguauuugacuaguugacauauuugugcuuaagaauuguggauuauaugugaaaucugacuucuuaacagggauauauuucuaccuuaauaacaaggg

SEQ ID NO: 2249817 - RNA, 76 nt, Homo sapiens
ucacuugagucugggagguugaggcugcagugagucgugaucacgccacugcacugcagccuggccaaccgaguga

SEQ ID NO: 2249818 - RNA, 76 nt, Homo sapiens
agagggagagaagagcuacagcccuuguaggagcccagaccugggagcucuccuaaccagggcuguuagucccucu

SEQ ID NO: 2249819 - RNA, 110 nt, Homo sapiens
ucugggggccaguggcaugcaccucuuuaucauugugcaucuucauuccacuaaaccugcaguaguggcugaauaccacaauuagagcugcauggagccugggcccagga

SEQ ID NO: 2249820 - RNA, 57 nt, Homo sapiens
guaagaacaagccccaaacucuggccucucccacagacuugguugguuauuucuuac

SEQ ID NO: 2249821 - RNA, 106 nt, Homo sapiens
guuucagaucagcugaauagaaauuagcagguggugaccacauuuuauaauaugauuuuugaagaaguauaacuauuugcuuucuucaauuuaguuuuuuaaaaac

SEQ ID NO: 2249822 - RNA, 129 nt, Homo sapiens
ccagucuugggguaauaucuuuauagcagugugaaaauggacugauacacuaaggaaaaacucaauccuugaaauagacuguugcauuagucuguucucacacugcuauaaagaaauacccaauacugg

SEQ ID NO: 2249823 - RNA, 79 nt, Homo sapiens
ggaauggggacaaauggccacugaccuguguugaaauaauuucacaccaggagcagugccagauguuucacccaucuuc

SEQ ID NO: 2249824 - RNA, 58 nt, Homo sapiens
gcauguguguacuuaugacugagaauuaaacuaguacagucauaggaguacauaaugc

SEQ ID NO: 2249825 - RNA, 67 nt, Homo sapiens
ggaauaacgcuuugaacuugguaggugcacaauaaauauuuuucuauuaagugaaugaaguuguucc

SEQ ID NO: 2249826 - RNA, 89 nt, Homo sapiens
gcucagagcuucaaguaagaagugggcauaaaaauccaauucuggccucauuuacucucauuuauuuacucuuuuuuaggucuuugagc

SEQ ID NO: 2249827 - RNA, 121 nt, Homo sapiens
cugcauaaaauuacaacggcacccucuuuagaagagauuuugauuuauauaaugguagugacuuuuauguguuuaauguuucugaaacuaaaagaggagaugagccccugugagcaggcag

SEQ ID NO: 2249828 - RNA, 64 nt, Homo sapiens
guaaucucagcuacucaggaggcucaggcaggaaaaucacuugaaccugagagguggagguugc

SEQ ID NO: 2249829 - RNA, 65 nt, Homo sapiens
gagauggagucuugcucuguugcccaggcuagggcauugucuuggcucacugcaaacuccgccuc

SEQ ID NO: 2249830 - RNA, 108 nt, Homo sapiens
uuucuuugcagcccuguguccaagcaccguugccuccccugcaucccauuucugucugggaugguugugcagggggcaauggugcuuggacacagggcugcaaagaaa

SEQ ID NO: 2249831 - RNA, 69 nt, Homo sapiens
uguggugagcugagaucgugccauuguacuccagccugggcaacaagagcgaaacucagucucaaaaca

SEQ ID NO: 2249832 - RNA, 129 nt, Homo sapiens
gcaugauuugucugaaguuuuauggcuagucagaggugguggagacuagccccuggguuuuuggcuaaacaauccaguguuucuuccacuauuucaugcugcuguuguuuaacauagauuuauccaugu

SEQ ID NO: 2249833 - RNA, 77 nt, Homo sapiens
ucugagaacaucauucagauauuuuauaguggacuuuucuuaauuucuucccauaauaucaaggugauguucccaga

SEQ ID NO: 2249834 - RNA, 56 nt, Homo sapiens
aggccuuuugaauuugcuuaaaacuauuaagaaguaauuaaguaguuagagggucu

SEQ ID NO: 2249835 - RNA, 66 nt, Homo sapiens
guuauagaaggaucuaaaugguaucccauauucaggcacagacacauugcagauccuucaaaugac

SEQ ID NO: 2249836 - RNA, 66 nt, Homo sapiens
guucaaguuuucucuuguggguuauacugugucccuuaauuuucagaggagagcaaagcuaugagc

SEQ ID NO: 2249837 - RNA, 78 nt, Homo sapiens
accagcaaugauaaggcagcugcuaaaaggcauucagaacugaacauugccuauuaauaggugcuguguacaguuggu

SEQ ID NO: 2249838 - RNA, 99 nt, Homo sapiens
gagcugccagcauggcuagaaugaagcagguaggagaaauuggagagacuagacuuguugagucuuccagccuccaucuuucucccaugcuggaugcuu

SEQ ID NO: 2249839 - RNA, 110 nt, Homo sapiens
uaguuauauuuuaauucauugaacaaauauuuauugaucaaccauuauaggccagaccugugacaaauuuaguggacuguuuguuaauuuaguugaacauauacuuacug

SEQ ID NO: 2249840 - RNA, 86 nt, Homo sapiens
cacacuaagcuuaccaugaagguggagagagaaagcuagcacauguggcuucuuccuugaguucuucauggaaaagauggggugug

SEQ ID NO: 2249841 - RNA, 76 nt, Homo sapiens
guaguugugaugguuauguaagaagaauccauguuguacucuaagcauuaugucuugcacaaauuauuuuaacugc

SEQ ID NO: 2249842 - RNA, 62 nt, Homo sapiens
gguuguuacuaaaauaaugcacauuguucgcuucaaaagugccuucuauuuuagugacaguc

SEQ ID NO: 2249843 - RNA, 56 nt, Homo sapiens
uaauacauucaaggugguaguuuuacgagcccuaggugccacacugagugauguua

SEQ ID NO: 2249844 - RNA, 57 nt, Homo sapiens
ugagacugagucuugcucugucacccagguggagugcaauggcaugaucucagcuca

SEQ ID NO: 2249845 - RNA, 74 nt, Homo sapiens
ggcaaguaauacaggauuauuuuagaguaguuacuggaaaggucuccuaagugaauucauuguguuauauugcc

SEQ ID NO: 2249846 - RNA, 91 nt, Homo sapiens
cugggagaugcuaugguguuauuuuugcacuacaagggcucugaagacugccaggcuugaagugaagaacaauaucaccugccuaucccag

SEQ ID NO: 2249847 - RNA, 130 nt, Homo sapiens
ccugugguuucuuugcaggaaucuucuuaagcuguuugacuauuguguguaggucaguuaaagcuagauaaacuaacccacgcagaauggacaaguggcuuaggaagauuccugcaaggaaaaaaauggg

SEQ ID NO: 2249848 - RNA, 88 nt, Homo sapiens
gauagcccaugaauacuuauaggauaagaacaagccuaacugacuuuauuucuuuguuuguauugucuugaugaguugaaugauuauc

SEQ ID NO: 2249849 - RNA, 61 nt, Homo sapiens
cuuuuaacauuaaaucuuauucuacuguaguaacaauauaaguggaaugaaauguuagggg

SEQ ID NO: 2249850 - RNA, 90 nt, Homo sapiens
ugcuccacaccuggcucacccuuggcagcuguggaaucugggcugguaacgcaagcugagcacagccugccaagcugagugaguggagua

SEQ ID NO: 2249851 - RNA, 67 nt, Homo sapiens
uuuagagucagugucuugcucugucacucaggcuggagugcaguggcaagaucacugcagcccugaa

SEQ ID NO: 2249852 - RNA, 60 nt, Homo sapiens
guauuaguuaucuacugcuguguaacaaacuaucccaaaccuaguaguagaaaacaauac

SEQ ID NO: 2249853 - RNA, 63 nt, Homo sapiens
gcauuaugccuuagauauugaauggcuagauuuacuaguagcaauggcucugagcuaucuugc

SEQ ID NO: 2249854 - RNA, 81 nt, Homo sapiens
cccucagauuuuuugagaucuauacuuuaugccagaagaaagaagaaaauggaauagcagguauuuaagaaacucagaggg

SEQ ID NO: 2249855 - RNA, 96 nt, Homo sapiens
acuuugauuaucauagauuuguaauauguuuugaaaucaggaaauguaaguccuccaacuuuguucuuuuucaaaauuguuuugacuauucggagu

SEQ ID NO: 2249856 - RNA, 81 nt, Homo sapiens
cacagagauacaucccugaggaauuucugcacugcaucauucccugauacaggugagaugcucucugggaggccuccugug

SEQ ID NO: 2249857 - RNA, 74 nt, Homo sapiens
ggggagccuccauauuguuuucuguaauggcuguacuaauuuucaauugcaucaacaguguacaaggguuuccu

SEQ ID NO: 2249858 - RNA, 72 nt, Homo sapiens
gucuuuuucuuacccuuuaacccuuuaaaguguuuaugugacacuuuaggguuaggggagucucuugagggc

SEQ ID NO: 2249859 - RNA, 101 nt, Homo sapiens
ucuauuucuucccuuuuaauccuuaucuuucuuauucuguuuugccugugguacuggcuaggacuuccaguacacuguugaacagaagugaugauaguaga

SEQ ID NO: 2249860 - RNA, 109 nt, Homo sapiens
uguacacgugguuggcaaugaaaauggaagauggaucugccauguugaacaugccuggccucuagguagucuuuuccuauugucacgauugccagcauucaccugugca

SEQ ID NO: 2249861 - RNA, 56 nt, Homo sapiens
gcuagguuggggaaguucuccuggauaauaucuuggaguguguuuuccaacuuggu

SEQ ID NO: 2249862 - RNA, 56 nt, Homo sapiens
auugguucuguuuaugugauggauuacauuuauugauuugcauauguugaaccagu

SEQ ID NO: 2249863 - RNA, 66 nt, Homo sapiens
ugcccuucuuugucuuuuuugaucuuuguugguuuaaagucuguuuugucagagacuaggauggca

SEQ ID NO: 2249864 - RNA, 87 nt, Homo sapiens
gcuauguagcugucaauguaucuagcuguauuaucacuuaggagaguuccugaugcacaauggauacuauugaaagacaaauguagc

SEQ ID NO: 2249865 - RNA, 68 nt, Homo sapiens
ggcuauugucaguguucacucaaagcucaagggcucuucagugaccuuguggugaaugcuggcaggcc

SEQ ID NO: 2249866 - RNA, 71 nt, Homo sapiens
gcuugaacccgaggcggagguugcagugagccgaaaucgcgccauuguacuccagccugggcgacaagagc

SEQ ID NO: 2249867 - RNA, 75 nt, Homo sapiens
uuaaugugcuucucuaccauagggucauuuagaaauucuuucuccucuugcuuucugugguagcaagcaaauuaa

SEQ ID NO: 2249868 - RNA, 78 nt, Homo sapiens
aguaagagaagagaaaagaaguguucagaucuucacuuccagaaagagaguggauacauuuuuccuccucuucuugcu

SEQ ID NO: 2249869 - RNA, 60 nt, Homo sapiens
cucagggacaguaucauuuaggagaauauguuuuuauugcccuaaauugcuucaccugag

SEQ ID NO: 2249870 - RNA, 88 nt, Homo sapiens
accauaggugucggccuuacauugcuucaaauucagugugaaaacacaaaacucacacgauaaaguacaguguaaagugacauauggu

SEQ ID NO: 2249871 - RNA, 55 nt, Homo sapiens
uugagauggugccacuguacuccagccuggguuacagaaugagacucuaucucaa

SEQ ID NO: 2249872 - RNA, 84 nt, Homo sapiens
ccccaguccauucccacaauugugguaggaguugccauguuucuacagaaccuggacuuccugccacauuugucuggucugggg

SEQ ID NO: 2249873 - RNA, 76 nt, Homo sapiens
agugcuacucuggugaaaacauucaugauaagaaaacaaagcccuaauuacuauggauauugccuaggguaguacu

SEQ ID NO: 2249874 - RNA, 80 nt, Homo sapiens
gcgggguuuaauaccuaggugauggguucauaggugcagcaaaccacuauggcacacguuuaccuauguaacaaaccugc

SEQ ID NO: 2249875 - RNA, 64 nt, Homo sapiens
gccacguucuuuguuuucugauccugaagccuuugcggccucauuucgagaacaaggugcuggc

SEQ ID NO: 2249876 - RNA, 79 nt, Homo sapiens
ccuggguguauucauuggccugaucaacacaaugaccaaaucuggucacagugcaggaucaguuaaugacuguccuagg

SEQ ID NO: 2249877 - RNA, 97 nt, Homo sapiens
ucauucaagagauuuauugaacaugccauauguaccagcuauugugcuaggugcuggugauauaacauguauaauaaagaaacaaauuuugugauga

SEQ ID NO: 2249878 - RNA, 127 nt, Homo sapiens
caguaagugcguguauagguuugcuaccuggguauauugcauagugcugagguucgggguauaaaagauccugucaccuagguacugagcaucuauacccaacagcuagccuuucaacucuugccug

SEQ ID NO: 2249879 - RNA, 76 nt, Homo sapiens
agaauacaucaugugcaaaccauggcauuaaacagauuagaaaaacuaaaugucauacaguaacaugguugguucu

SEQ ID NO: 2249880 - RNA, 122 nt, Homo sapiens
agauauuacuccuauuaucacuguggguguacacucugugauaugauucauaauaucuaaaagaagauauugcuccuaauaccacggugaguguacacacugcgauacuauuuguaauaucu

SEQ ID NO: 2249881 - RNA, 76 nt, Homo sapiens
uccaaauuacuguauacuucugaaaauagcuauuaaacugaccagaauaaggcuauagagaugugcauuaaaugga

SEQ ID NO: 2249882 - RNA, 104 nt, Homo sapiens
cauaggaagacagauacuuagauaguacuuagggaaauagagguacaacuaccaggacucuguuuuucuggcagucucucuccuugggugucugagugccuaug

SEQ ID NO: 2249883 - RNA, 86 nt, Homo sapiens
gaauagaauguauauucugcaauuguuggguagaauguucuguaaauauauguuaaguccauuuguuguaggguauaguuaaauuc

SEQ ID NO: 2249884 - RNA, 84 nt, Homo sapiens
acagcuggcaaauaguagagccaggauuuuagauugagcaaucuagugcuacaguucuuggccuuaacuacuuugcuuugcugu

SEQ ID NO: 2249885 - RNA, 58 nt, Homo sapiens
ugagauucuggguggauauaaauuuggggggaacucuauuaaaucuagugcagacuca

SEQ ID NO: 2249886 - RNA, 121 nt, Homo sapiens
ccuagaccuaaagggaacuuugaaagaaaggagacugaguucauuuacaaaggguuaaaagagugauauuuaagcugugucugaagauuuuuuuuaaagauucuacaagaucuuggcuagg

SEQ ID NO: 2249887 - RNA, 66 nt, Homo sapiens
cacuuugcacucaguaagugggagcuguuauuauuucacggguucugugugcuugagugcauggug

SEQ ID NO: 2249888 - RNA, 74 nt, Homo sapiens
ccaggcuacugccuguguucacuuaaggcugaagggcuucucagucagcuuguggugaauacugcuaggccugg

SEQ ID NO: 2249889 - RNA, 61 nt, Homo sapiens
ggggauaucuaagagucuuugugagucucuacgaaugaauuuuaugacucuggguguuccu

SEQ ID NO: 2249890 - RNA, 128 nt, Homo sapiens
uaaaguuuuccagaccgaggaaaagguuaucuauuugucuacagcucuggagcuuuuggcuagugcuucuggguucaaaaucucuuagcugugucuccgcuuaaggauaacucuccugggauucuuua

SEQ ID NO: 2249891 - RNA, 89 nt, Homo sapiens
cugugaguccggggcucucuucccuguaucuucugccauguaguugcugggugggcaugagguagggaauggagucaauggugaagcag

SEQ ID NO: 2249892 - RNA, 62 nt, Homo sapiens
aucuguguuuaaggucccagaaaauuuuugagugucuguuuucuaagaucugaaacucagau

SEQ ID NO: 2249893 - RNA, 61 nt, Homo sapiens
gagaguucaaagggacuuaugaagauaacauuaagucuuuaagugcuuuucugaaacucuu

SEQ ID NO: 2249894 - RNA, 72 nt, Homo sapiens
gugcaauuagguuauuacugacaauaaucacccuguuguggguaauuguuuuagggguaacaggaacugcac

SEQ ID NO: 2249895 - RNA, 100 nt, Homo sapiens
ucuggcucaaguuucuaauauccuuuuaaauguaaaugagaaauauauauacauuauuccauugaacaugaaggaaugugugccauggauuuggcccaga

SEQ ID NO: 2249896 - RNA, 75 nt, Homo sapiens
ggacuuuaggggccuccagauucaggugaugggaacccuggguucccgaggacaucugggggcaaacuuggaucc

SEQ ID NO: 2249897 - RNA, 77 nt, Homo sapiens
aguggaagucuauggcauuugagucacaauguccucccuacuucccauuuuuagcucaaugugguggaaacuccacu

SEQ ID NO: 2249898 - RNA, 111 nt, Homo sapiens
guaguuauguucuaauaaaacuauuuacaagcacaggcagcaggcuggauuucaucugcagguguaguuugcugaccaugguuuagaguauguguucugggauguggcugc

SEQ ID NO: 2249899 - RNA, 60 nt, Homo sapiens
ugugaauagugcugcaaugaacauaugcauguguguaucuuuauaauaguaugauuuaua

SEQ ID NO: 2249900 - RNA, 58 nt, Homo sapiens
uguggagcuguguggccuugggcaagugacuuaacugcucugagucucagcuaccaca

SEQ ID NO: 2249901 - RNA, 70 nt, Homo sapiens
ggucugcauugaagaaaaagaaaugaauguguugagaacgacuucauaguauuuuucuccaaauaagacu

SEQ ID NO: 2249902 - RNA, 65 nt, Homo sapiens
ccugauuguagagccccagggcuucgagugaccauaggugguagccagggagugguugcagcagg

SEQ ID NO: 2249903 - RNA, 77 nt, Homo sapiens
gucaguaaagaaguaacuuguuuaggcaaagcacguuauggcuuuuucuugccuaguuuaggucugugcuuaaugac

SEQ ID NO: 2249904 - RNA, 78 nt, Homo sapiens
aucucaaccucugaggacagaagggggcucucaaauccgcccaugcauugagaucuucgcucuucacagaggugggau

SEQ ID NO: 2249905 - RNA, 96 nt, Homo sapiens
ggucagugaggcagaggaagcagcuggccugagcgguggcgggugagggcaacacgcugucacugggaggggcagcagucccugcuggaccugacc

SEQ ID NO: 2249906 - RNA, 83 nt, Homo sapiens
ccaugcuuggaguggaagcaagggauggugugagaaauagaaaaauucuuacaucaucacauuaguuugcgucuccuguuugg

SEQ ID NO: 2249907 - RNA, 58 nt, Homo sapiens
ugagauaggaucuugcucuguuguccaugcuggaguacaguggugugaucauaucuca

SEQ ID NO: 2249908 - RNA, 57 nt, Homo sapiens
ucacagacauugaggggaccuuagagacccaucuaacaaaaccccuuugucauguga

SEQ ID NO: 2249909 - RNA, 61 nt, Homo sapiens
uugauauguuguuagauucaguuagcuaguauuuuguuaaggauucuagcaucuaugucaa

SEQ ID NO: 2249910 - RNA, 55 nt, Homo sapiens
uucccauuguuggccagcaugucauuuugacuuuuguugguuuuauuagugagaa

SEQ ID NO: 2249911 - RNA, 68 nt, Homo sapiens
uguaaagguguuucacuguuguuuuaauuuacaauucccuaauuauauaugguaguagcaccuuuaca

SEQ ID NO: 2249912 - RNA, 78 nt, Homo sapiens
uuuuuuguuacuacagcaagccuaccccauccuacauaccagucaggaugggguaggcuuugcugcaguaacaaaaga

SEQ ID NO: 2249913 - RNA, 58 nt, Homo sapiens
uuucuuuggauaaaguuuuaugcaccaugcuuggguugcagaagcagauccaaagaag

SEQ ID NO: 2249914 - RNA, 60 nt, Homo sapiens
ggugagcgaggaaacgacggcgcgccuggccugcagugggcucacguguucuugcucauc

SEQ ID NO: 2249915 - RNA, 91 nt, Homo sapiens
gcugagauggauucucucuguuguguguuucagucuacuaagagauuuuuaucagcacugaucauacagcuucaguuuucaugcacuuagc

SEQ ID NO: 2249916 - RNA, 70 nt, Homo sapiens
aaugaucaaaugcaugaauaagcucgugugugaccacucuguucauaugggccugauuauggauauuauu

SEQ ID NO: 2249917 - RNA, 58 nt, Homo sapiens
cuucugguuugccugcacuggcuucaggaagcuggagcccugugacucgaacgaggag

SEQ ID NO: 2249918 - RNA, 89 nt, Homo sapiens
uaauauuucuucuguuaguucugauaacuuaugguuucaaguugcugucuauuuuauugaguuugucaaauuuauaggcagaaauauua

SEQ ID NO: 2249919 - RNA, 63 nt, Homo sapiens
uggccagacaagacuuggagcucuuucauuauucaggaaaugagaaugauucuguuaugguca

SEQ ID NO: 2249920 - RNA, 57 nt, Homo sapiens
gagggcuuacuuugugccagaagcgucgcagccagaacugauacagccugagcucuc

SEQ ID NO: 2249921 - RNA, 74 nt, Homo sapiens
gguuucaucacuucaucuguauagcccuaccugggucuucucaggcuugacucuuacaguguguggugaaagcc

SEQ ID NO: 2249922 - RNA, 58 nt, Homo sapiens
ugaggugaggguaucaaaugcugaacacuccuguaacccauuuauaucccacagcuca

SEQ ID NO: 2249923 - RNA, 57 nt, Homo sapiens
gaccuuagauuaucuguaugugcucuuucagauuuacugaaguagguauuuaagguu

SEQ ID NO: 2249924 - RNA, 130 nt, Homo sapiens
agcuaucauggcauuccugggauaacuuguucauauugugcugucuuugugaugugcuguuggauuuguuagcugguauuuugucgaggacuuuuguaucuauguucaucagggauauuggccuguaguu

SEQ ID NO: 2249925 - RNA, 68 nt, Homo sapiens
gauggggugaugggcagaguuaaggucuagacagcauuuugagaucuuugcuguccucaccaugaguc

SEQ ID NO: 2249926 - RNA, 62 nt, Homo sapiens
aaguucagaagguuucuguuaacugggaggcaaguuaaggguaacagcacugucugaagcuu

SEQ ID NO: 2249927 - RNA, 79 nt, Homo sapiens
guggcacaacaaugugcauguacuuagugcuauuugaaccauacacuucaaaugacuaagaugguacauuuuauguuac

SEQ ID NO: 2249928 - RNA, 75 nt, Homo sapiens
cuuaaaaugugccuacuggagcuugcagugagccaagaucgugccacugcaauccagccugggcgacagagcaag

SEQ ID NO: 2249929 - RNA, 64 nt, Homo sapiens
gcacugcuuaguaaugggaccgguucugagaaauguguuuucagaccauuucauuacagacugc

SEQ ID NO: 2249930 - RNA, 71 nt, Homo sapiens
ugguuagcauagaaguaaugauuucauucaaaguugaaagaugaggcuauaauuuuuauguauuagagcca

SEQ ID NO: 2249931 - RNA, 61 nt, Homo sapiens
uccgugcuuuaaaccacugugcuguacugccgaguacaguauaaugcuguagggagaagga

SEQ ID NO: 2249932 - RNA, 83 nt, Homo sapiens
ugaggaucaaaugaauugauguguguguguuugcaugugugucuauauguguaauacacacauauaugcagucauaucacuua

SEQ ID NO: 2249933 - RNA, 97 nt, Homo sapiens
aaugacaugucuggauccagagaacugauucagggaaaauuacuuauugauaauauuuuguuuauuuugaauuauguuuuagaauucggaacacauu

SEQ ID NO: 2249934 - RNA, 55 nt, Homo sapiens
cugagcaaaaugaagacacgaugcagaauucagcaaaguucacaugagugcucag

SEQ ID NO: 2249935 - RNA, 71 nt, Homo sapiens
ggaucaucugugagacugguccugaacccagugacuuccaucucugggggcaguuccaucuccagugguuu

SEQ ID NO: 2249936 - RNA, 91 nt, Homo sapiens
uacuucucagcgugauucuuaaagucagaagcccuuggauacccaguagaauuucuagggacuagaacugagaaucauauuuuuggaagua

SEQ ID NO: 2249937 - RNA, 129 nt, Homo sapiens
ucuuuuugcucauuaacauuauuuucuuucagauugaagaacuuucuuuagcauugcuuguggcacaggucugguguugaaauucuucagcuuuugucugggaaaauauuucuccuuuaugucugaaga

SEQ ID NO: 2249938 - RNA, 70 nt, Homo sapiens
cuuguuuggcuacuguacuugagcuauuguaugauuucagcucaggaguuuggaugcaguagccggcgag

SEQ ID NO: 2249939 - RNA, 69 nt, Homo sapiens
ggucucuguugcucaggcugaagugcaguggcauaaucucagcugacugccuccugaguagcugggauu

SEQ ID NO: 2249940 - RNA, 56 nt, Homo sapiens
gagaagggcuuuuucucccaccagucauaguuguauucugggaagaaauucuucuc

SEQ ID NO: 2249941 - RNA, 59 nt, Homo sapiens
cucacccuguguuuugcguuugccccaccucauggugcacacgcgccacccagggugag

SEQ ID NO: 2249942 - RNA, 69 nt, Homo sapiens
cccugauuuaaaguguaugggaggguaugcauagguuauaugcaaaugcuacaccauuuuguauuaggg

SEQ ID NO: 2249943 - RNA, 83 nt, Homo sapiens
agucuguagguaguuaauccugucuugccauccaauaauauaaaauuguaggaauguguaauaugggaacuccuaccaagacu

SEQ ID NO: 2249944 - RNA, 74 nt, Homo sapiens
cuaugcacacugaguauaacugaccuuaugagaacaucauucucacuaagauuaugaugugcuuucuugugugg

SEQ ID NO: 2249945 - RNA, 88 nt, Homo sapiens
cugacaggugugagauaaugucucauugugguuuugauuugaauuucucuaauaaucagugaugagcuuuguuucacaugcuuguugg

SEQ ID NO: 2249946 - RNA, 71 nt, Homo sapiens
uacauauauaacguaaugaggugauggauaugcuaauuacccuuauguaaucauuauacauuauaugugug

SEQ ID NO: 2249947 - RNA, 98 nt, Homo sapiens
uugugugucugugguuccauggcucuguuccaugugucuucuuauucuaggaacagaugagggaagagcuuuuagcugggauugccauucccacacaa

SEQ ID NO: 2249948 - RNA, 92 nt, Homo sapiens
uuucggguaucuuuacagcagugccccacucuacugguacccauuuacuauauuagucuguuuucacacugcugaugaagacauaccugaga

SEQ ID NO: 2249949 - RNA, 69 nt, Homo sapiens
auagccaguagagagcuguuagacuccuacacguuuauaaaucucugcucagcuucaucucacugcuau

SEQ ID NO: 2249950 - RNA, 55 nt, Homo sapiens
agggaacauuugcacuguuggugggaauguaaacuagacaguguggagauuccuu

SEQ ID NO: 2249951 - RNA, 64 nt, Homo sapiens
cauuuuauaugcggucuguugugacugaaacacaguuaugcagcacaugacuguauguauaaug

SEQ ID NO: 2249952 - RNA, 76 nt, Homo sapiens
gcaggaagugaauggugggcuagcuagugaagcuucaucuguauucacagccgcaccccaucacuugcauuucugc

SEQ ID NO: 2249953 - RNA, 73 nt, Homo sapiens
gcuucucguuuuguuucuacuguaggauuuucuaugugcauaaucauacuguugugaaacaaaacaaguaagu

SEQ ID NO: 2249954 - RNA, 80 nt, Homo sapiens
uuucuuauuuuguacuggguuuucuggaauuuggucuuaaaacugauuaaaugucccuauuuccagugauaaagaggaaa

SEQ ID NO: 2249955 - RNA, 101 nt, Homo sapiens
uuucauuuggugacauuuccaaaguaguguguaggaaaguuguucaugugaugcuuauaaaggucacagggcuaacauuuuugcccacuucaucugugaga

SEQ ID NO: 2249956 - RNA, 105 nt, Homo sapiens
auguuaaggacccauuguuuggguccuuauugauaccaauggccauaauaaucucuaaauuuauuuauucauuaacagggaccaaagucaauagggccuuaauau

SEQ ID NO: 2249957 - RNA, 60 nt, Homo sapiens
auauagccauagugcuuaaauucuuuuuggauuuuccuuggauagaaaacuuggcuguau

SEQ ID NO: 2249958 - RNA, 95 nt, Homo sapiens
acauuggcgucaccuggaaacaucuuaggaaugcagagucuugcccccagccccaccgaaucugcauuuuagcaggguguccaggugcuuagugu

SEQ ID NO: 2249959 - RNA, 127 nt, Homo sapiens
caugauuguguuuugaaaugugaggacaugagauuugggaggggccaggaguggaaugauaugguuaggcuuuguguccccacccaaaucucaucuugaauuguaguccuauaauccccacaucaug

SEQ ID NO: 2249960 - RNA, 79 nt, Homo sapiens
uucuccagaacucugccuacugguuggaggaacagugcugaacccaaaaugauuaacuguuuuaggcaaggcuggagaa

SEQ ID NO: 2249961 - RNA, 66 nt, Homo sapiens
gaguugaaaguguucacaaugguauuuacauuucaaaaacuauuuguaugagcauuuuaccagcuu

SEQ ID NO: 2249962 - RNA, 79 nt, Homo sapiens
uauguacagacauuauucaggcuacacugauugucccaggaauguccuuuguagcaaauaaaagucuggauuauacaug

SEQ ID NO: 2249963 - RNA, 81 nt, Homo sapiens
uccaaggaguuuugauguagaaagagugggcuggaguggaggcaccaacacucugugaccaauucucagaagauuccugga

SEQ ID NO: 2249964 - RNA, 76 nt, Homo sapiens
cuccagcaucuagcaauuguccucuucccucacuguguuaggucucggggaggucauuguucaaugcuguuccgag

SEQ ID NO: 2249965 - RNA, 78 nt, Homo sapiens
agaguagccuuccagcugcaauuacauggguuccucaccuuucucuccuccucagauugcccuugaaggcuaaacucu

SEQ ID NO: 2249966 - RNA, 71 nt, Homo sapiens
uucuggcuaugggauacuaaaucuuccaacaacgaucugagguuuaaauuuaguuuucucguagcccagaa

SEQ ID NO: 2249967 - RNA, 60 nt, Homo sapiens
aguuaacccuuaguaucuguggguuccacgugcggagccugcagauauggagggcuaacu

SEQ ID NO: 2249968 - RNA, 114 nt, Homo sapiens
accuuucuauuguagugauaaggguuaaagacauccacauaggaggagacucagcaaguccuuuucuguuuuuuugucuuuuggucucucuuguccuuaggagucugacaaggu

SEQ ID NO: 2249969 - RNA, 77 nt, Homo sapiens
guuccugagcugggaagucaauauuucgcaccucaggcccugcugaguggaagaccagacuuuccaacaucaggaau

SEQ ID NO: 2249970 - RNA, 68 nt, Homo sapiens
aggggcaugaauacucuuuggguguauguuuccugaacauggcacagagaauguguucugggguuccu

SEQ ID NO: 2249971 - RNA, 69 nt, Homo sapiens
gggagacucuggguuaaagaauuuuacaauccuuuguuaauugugagauucucugauuguaggucuucu

SEQ ID NO: 2249972 - RNA, 103 nt, Homo sapiens
ugaggcaggagaaucgcuuaaacucgggagggggagguugcagugagccaagaucacgccauugcacuccauccuggguugacaagagugaaacacugucuca

SEQ ID NO: 2249973 - RNA, 70 nt, Homo sapiens
aguagcuuagccuuuacaccuacuuuauauccuggagaagaaauugagguagaggugaacuugaccuacu

SEQ ID NO: 2249974 - RNA, 56 nt, Homo sapiens
ugggaaguuuggcuuuuucacagcauguuggcuaggguguaagagcaagcuuccua

SEQ ID NO: 2249975 - RNA, 64 nt, Homo sapiens
guaaucucagcuacuugggagguugaggcaggagaaucccuugaacccaggaggcagagguugc

SEQ ID NO: 2249976 - RNA, 81 nt, Homo sapiens
uauggauuuugagcauggaaauggcaugauuagggcugcacuucaguaaauucacuuaucacuuuuagcuuagggucuaug

SEQ ID NO: 2249977 - RNA, 96 nt, Homo sapiens
uagauagaguggcauggauucaauuuuguaugcauaaauuaaauuuguaauguuuaagcaguggauuagaauuuuaacaugcuuucacuucauuug

SEQ ID NO: 2249978 - RNA, 78 nt, Homo sapiens
guuggcacagaaguaauuguagucuuugccauuauuaauaaaaguaauggcaagaagagcaauuauuuuggcaccaac

SEQ ID NO: 2249979 - RNA, 56 nt, Homo sapiens
uccugagggcgucugugcaguacuugcacaguguugacugcauuuaguccucagga

SEQ ID NO: 2249980 - RNA, 81 nt, Homo sapiens
uugcaggauucuuugagguaugacuuauuauucuucauuuauaaauuaggaaauugugucucauauuagagaauuaugcag

SEQ ID NO: 2249981 - RNA, 83 nt, Homo sapiens
uccccaguucugaaccuuuguggcugagcgucugcuucucuggucuguuucuguaucagcacaguggguucauggaaagggga

SEQ ID NO: 2249982 - RNA, 83 nt, Homo sapiens
gaaaugaaugaaaauuauaagaaacaaggcaaauuuugaggguaucauuuaucaugauaucuuguuuuucaugcauccauuuc

SEQ ID NO: 2249983 - RNA, 71 nt, Homo sapiens
uuuuaaccugggcauucuuugaguucucaguuucgaggugauggggagcaaaaaugaugcccaaguucaaa

SEQ ID NO: 2249984 - RNA, 60 nt, Homo sapiens
cuuuaugagguuggauggaucugggcuugaauccugauucauuuucuacuuugcuugaag

SEQ ID NO: 2249985 - RNA, 73 nt, Homo sapiens
cauaggauggagggcuagucauuucuuuuuguaucuuuuacauaaaaaucuaugacugcuucuccucugaaug

SEQ ID NO: 2249986 - RNA, 66 nt, Homo sapiens
aaacacugguucagaaaaugagugguuagaaaagaaauacuauuacuuuuauugaacucagcguuu

SEQ ID NO: 2249987 - RNA, 69 nt, Homo sapiens
gcuagaaaaagcuuagaugggcuuguauugacugguaguugaaauacaaucauuuaagacuuugcuggu

SEQ ID NO: 2249988 - RNA, 78 nt, Homo sapiens
gcuuugcuagagcugguaaaauggaaccaaaucgccucuucaauggauuugguccccuucaaccagcuguagcuaugc

SEQ ID NO: 2249989 - RNA, 85 nt, Homo sapiens
cuaaaggggauuuuugguggaauuuuuaguuuucuauguauauguugccugagaacagagauaauuuuacuuccuuccucuuugg

SEQ ID NO: 2249990 - RNA, 60 nt, Homo sapiens
aggauucauaggaagccgggugagugggcgucuuuuacuccccuuguucugugagcuccu

SEQ ID NO: 2249991 - RNA, 80 nt, Homo sapiens
uuauggacauuaaagcgauguagaaaauguuaauaaacccgagaaauaaagcauaaucuacauuuucuuuauguacauga

SEQ ID NO: 2249992 - RNA, 62 nt, Homo sapiens
uguccauuuuuaugcuuauggucaacaaaguauggacagccauguagaaauaugaguggaca

SEQ ID NO: 2249993 - RNA, 66 nt, Homo sapiens
caugugcaaagcacuguucagcaggggagcucaccugagccuugcugucaagggcuuuagcaugug

SEQ ID NO: 2249994 - RNA, 78 nt, Homo sapiens
cacaccccuggauagagauugaugaugcuaaugagccacacaaugugugaacaagcacguacagcuacuguccaugug

SEQ ID NO: 2249995 - RNA, 96 nt, Homo sapiens
gaagggaacacaugauaggucuguuuugaaaaggaauggggacagaacaaaauauuacuaggucugaucaaaagaggcuuguucuggcuugucuuu

SEQ ID NO: 2249996 - RNA, 81 nt, Homo sapiens
ggggccgccccaggcgugaggccugccggggugacgacaucugucacccgugcucacugccucugccuugggucccgcccc

SEQ ID NO: 2249997 - RNA, 86 nt, Homo sapiens
uguauuccugcauguaugaauacauguacucaugaacauauaacauguacucagugaauacauguacucaugaauguaugaauaca

SEQ ID NO: 2249998 - RNA, 61 nt, Homo sapiens
uugagauggaguuucgcucuuguugcccagacuggaguacaguggcgcgaucuccacucag

SEQ ID NO: 2249999 - RNA, 82 nt, Homo sapiens
aaaggcgcaggaaggggcccugaagaggcugggggcaugagggagucuucagaucuucagcaggggccccugaggcaucuuu

SEQ ID NO: 2250000 - RNA, 69 nt, Homo sapiens
ugaacagacugaccucugaccuugccuuccaugacaugguugcuggcuucuuagagaucaucugcuuca

SEQ ID NO: 2250001 - RNA, 129 nt, Homo sapiens
cucccuguuggcccacagcugcuaaaaaacaaggugaguggugcuuaaguucaggcuugauaaaccacaacugagcuggacuuugcaccacuucacccucuacagcagucacugaauuccugcugggag

SEQ ID NO: 2250002 - RNA, 78 nt, Homo sapiens
ccauaagggacucuuuaaucucuuuuauccaaugaauuacaucaugugcaagaucauuaaagcucugguccucugugg

SEQ ID NO: 2250003 - RNA, 85 nt, Homo sapiens
aucaguggccucuuugcuucuggcaucauugcuacaacaguaaaauuugcauccagaaguagacauauccaauccauaaucuggu

SEQ ID NO: 2250004 - RNA, 59 nt, Homo sapiens
uucucuuuccacagcauguccaugcuacccuuuagugugcaauuuugugggaggcagaa

SEQ ID NO: 2250005 - RNA, 66 nt, Homo sapiens
gugccuuggaaaugguaaaggguuaauauacuuauuaaucuggcuaacauuuuuuagagagggcac

SEQ ID NO: 2250006 - RNA, 69 nt, Homo sapiens
ucacuugaacucgagaggcagagguugcagugagccgacauagcaccacugcacucucagcuuggguga

SEQ ID NO: 2250007 - RNA, 110 nt, Homo sapiens
aacuuucuagccagagcagcagcacagugaaugguuuacucacagcuccuuugucugcugaugggagauuuggcacugugcuugccucuugggcuuaccugagcaaaguu

SEQ ID NO: 2250008 - RNA, 82 nt, Homo sapiens
ggaccaauuagauucacagaaaaaggcgaugagguguaauguccuguauauaaauugucauuuuuuggaagguuagugguuu

SEQ ID NO: 2250009 - RNA, 79 nt, Homo sapiens
augagugaaauccuuaaauagugggaccaaaguacccuuuccaguauaagcuuuggucccaaugugauaaggucaucgu

SEQ ID NO: 2250010 - RNA, 86 nt, Homo sapiens
ggugugcuuuaaugacuaagaccuaaaauugugaauauuuauacauaaacauuccaguuguaagguuuuucauaagaaaguugacu

SEQ ID NO: 2250011 - RNA, 72 nt, Homo sapiens
agugcucaggcggcaauagugguagacagggcugggcaauucccaagucuccggauguuguuuuugggcacu

SEQ ID NO: 2250012 - RNA, 129 nt, Homo sapiens
cucggccucccaaagugcugggauuacaggcuuaagccaccgugccuggccuaaaaaagccuguuuaaaaauguuuuaggcugggcacgguggcucaggccuguaaucccagcauuuugggaggcugag

SEQ ID NO: 2250013 - RNA, 58 nt, Homo sapiens
uucacgguguucacggggguccagaacaucagcaggauccaccucguggacaagugga

SEQ ID NO: 2250014 - RNA, 89 nt, Homo sapiens
ggagaaucauuugaaaccaggaggugaagguuguggugagccgagaucacaccauugcacuccuuucugggcaacaauagugaaacucc

SEQ ID NO: 2250015 - RNA, 128 nt, Homo sapiens
agcuccucugaaacaagguggaaucaugggguuucagcguggggugcugaagacuugcacuaugcagcucuccucacaugccacauugagucccagauuucugcaaccacagaaguuuaagagaagcu

SEQ ID NO: 2250016 - RNA, 57 nt, Homo sapiens
ugucacugugacggcaguuacaugaaucugcacaugagcuaaaacugcacagagaua

SEQ ID NO: 2250017 - RNA, 88 nt, Homo sapiens
acauuucuguucugaguuuuaaacuuuaucauuugagccuuuuucauaucuucaaauguuuguuuaaggcuuauuaggacugagaugu

SEQ ID NO: 2250018 - RNA, 61 nt, Homo sapiens
aucccugugauccaaucacuuccuacaggucccucccucaacauguggggaucauggggau

SEQ ID NO: 2250019 - RNA, 107 nt, Homo sapiens
uucacucaaagguaaagacucuuagguaagaaauuuuaacacagcccaugcagaagagauggcugauguucucuuacaacuuaggcagguacuugccuuuaaaagaa

SEQ ID NO: 2250020 - RNA, 68 nt, Homo sapiens
agggagugagucagucugcuguugcuuacucucggugcuggcugagcucagcaaccugcucucuuccu

SEQ ID NO: 2250021 - RNA, 68 nt, Homo sapiens
gacacagcguggguugguguugcauugcauuagagguggccaagaugcacaguccagcccaugugguc

SEQ ID NO: 2250022 - RNA, 64 nt, Homo sapiens
guaugacacaggaagcuuaaccuaucuauauaugagugauaaaugaggcauuuugugucauuac

SEQ ID NO: 2250023 - RNA, 73 nt, Homo sapiens
agugcuuugagcauauuuaagguaugcuaggcaaagcuaugauguuuaguagguuagguguauucaaugcauu

SEQ ID NO: 2250024 - RNA, 87 nt, Homo sapiens
ucucaaacaguaacacucuaaagggaugcacgaucuuuucuuuuauacaacagacagugcuuccaucuagagggucacugccugaga

SEQ ID NO: 2250025 - RNA, 91 nt, Homo sapiens
gcgggaagauugguugaacccaggaguucgagguugcaaucagcuaugauugcaccacugcacuccacccugggugacacagcaagaccgu

SEQ ID NO: 2250026 - RNA, 57 nt, Homo sapiens
caugaaagugagaaacuccuggguucuguagucuuagggguagacugcacuuucaug

SEQ ID NO: 2250027 - RNA, 96 nt, Homo sapiens
caagguuuucagaagcccagagacuguguaaauuugagccagagaugggggagccuggagagagacaugguccugggcugugucuguggggccuug

SEQ ID NO: 2250028 - RNA, 76 nt, Homo sapiens
uugcuugaaucuggcaggcagagguugcagugagcugagaucacgucauugcacuccagccuggcaauaagagcaa

SEQ ID NO: 2250029 - RNA, 130 nt, Homo sapiens
cucagccucucaaagugcugggauuacagguaugagacacugaauccggccugauggauuguuuuuaaaacugaaacucagcugggcaugguggcucacgccuguaaucccagcacuuugggaggcugag

SEQ ID NO: 2250030 - RNA, 80 nt, Homo sapiens
guccuugagauuaucuugaucuugaaaguugcuggccuuugagcaacuucuucaaacccucaagaugcauccccauggac

SEQ ID NO: 2250031 - RNA, 65 nt, Homo sapiens
auuggugaccugcggcaguauguacuucagugcaccuacugcuuacuguugcuuuagucacuaau

SEQ ID NO: 2250032 - RNA, 79 nt, Homo sapiens
guagagugcugggcacuggcucaugacaagugacacuuccucuccucaccuuuuugaugccaguucauugcacuuuugc

SEQ ID NO: 2250033 - RNA, 63 nt, Homo sapiens
auuuuaugguauaugaaauacaucucaauaaaguccacugagguguagagauauaccugaaau

SEQ ID NO: 2250034 - RNA, 56 nt, Homo sapiens
guggcacaauuaaguagcuauuagguuggugcaaaaguaguugcuguuuuugccau

SEQ ID NO: 2250035 - RNA, 60 nt, Homo sapiens
guuuugaccuucuaaagugcuguuacuuugccuaaaauggaaguauggaggaggcagaau

SEQ ID NO: 2250036 - RNA, 86 nt, Homo sapiens
cagguggaauaguguauaaaugucaacuagaucaaauucauugauugugguuuucagcuuauauauccuaacuuaauuucuaccug

SEQ ID NO: 2250037 - RNA, 74 nt, Homo sapiens
accacagaaugaacacuggauaaggagucagaagaacugacgucuccugauuuucuucacuguuugaucuuggu

SEQ ID NO: 2250038 - RNA, 66 nt, Homo sapiens
ccucucagucuucuuggaggcuucuugaagcugaagaaguuaagcaguaguuaaggagaggagagg

SEQ ID NO: 2250039 - RNA, 90 nt, Homo sapiens
cugggaaauugugaggcugguccugccucccaacuaggagaagccacaauaauuuauagaugggacgcaucagcuucauucaagucccag

SEQ ID NO: 2250040 - RNA, 59 nt, Homo sapiens
uggugacuauucucaugugguucugaagucaaacgaccacacuguuuagaauggcauca

SEQ ID NO: 2250041 - RNA, 60 nt, Homo sapiens
uacauucaauaugauacuagcuguggaucugucauauccggcuuuuuuuauguugaagug

SEQ ID NO: 2250042 - RNA, 61 nt, Homo sapiens
acuaguaccauucccaaaccaacugaaacacauucuucaauggcaaggucauggugcuggu

SEQ ID NO: 2250043 - RNA, 62 nt, Homo sapiens
gugggaggagaguuuacugcauuuuuaaaagcauuuuugaagagucuaaaucugucuuccac

SEQ ID NO: 2250044 - RNA, 88 nt, Homo sapiens
aauuauaacuaauuugggcaaaagcauuauuccacuuuggcaaauaauuuaaaaagcucuguauaaugcuuuucuagguugcauaauu

SEQ ID NO: 2250045 - RNA, 56 nt, Homo sapiens
uuaaguacuucccuguuggacaagccauuuucccagacaggcaaggagucacuuag

SEQ ID NO: 2250046 - RNA, 84 nt, Homo sapiens
cuggcugucagcuggggggacaaccucaggccccaaggcugcccgcacuccuuggcuuguuguccccugcuccaucaaagccag

SEQ ID NO: 2250047 - RNA, 94 nt, Homo sapiens
auaugcacauauuagguuggugcaaaaguaauugcgguuuuugccacugcuuuucauuaguuuugcaccaacuuaauaguuuacuauggcauau

SEQ ID NO: 2250048 - RNA, 63 nt, Homo sapiens
uacaaagcuaccagauucuguuggaucacauuuugguuuucuccagcaggguguagcugugug

SEQ ID NO: 2250049 - RNA, 69 nt, Homo sapiens
ggacauagcuagauaaccucauguuauuaagagccuacauauucuaucugagguuuuauucuaaugucc

SEQ ID NO: 2250050 - RNA, 57 nt, Homo sapiens
aagucagacagcugagcugccuaccagcugugcagcuuugggcaaguugccuggcuu

SEQ ID NO: 2250051 - RNA, 62 nt, Homo sapiens
cuggaagauuacuuuuuguugaaaaccacuguggauucuucaggaggagguuaucugucugg

SEQ ID NO: 2250052 - RNA, 77 nt, Homo sapiens
cauuuauugcugcaaaauuguucuuugcuccagcauuuagccauaguugugagcauauuaguauugcacucuaaaug

SEQ ID NO: 2250053 - RNA, 130 nt, Homo sapiens
cccaccuugguuucacaacaugcugggguuacaguugugagccaccaugcccuggccaagugaaauuaggaaugggcugggugugggggcucaugucuguaaucccuacccuuaggcaagcagaggcggg

SEQ ID NO: 2250054 - RNA, 74 nt, Homo sapiens
uauacaguagguacucaguaagugcuggcugcuauuggaauggugaccggcacuuacugagcacuuacugugug

SEQ ID NO: 2250055 - RNA, 72 nt, Homo sapiens
agaacagcauagcuuuacuucuuauucauauuacauguuuaacacuggguaacaguggggcuaugcuuaucu

SEQ ID NO: 2250056 - RNA, 60 nt, Homo sapiens
guggcagagucagagggaaaugucuacgucuaaucucccagcugcccucugacaucccau

SEQ ID NO: 2250057 - RNA, 105 nt, Homo sapiens
auuggagugauuuaugcucgcaucuugggugucuguucuuuuuuaaggaauucacuuacucugauagaccauccaggauguuuguuaguaggcacacccuccaau

SEQ ID NO: 2250058 - RNA, 67 nt, Homo sapiens
agucuuugccuguuaacauagcauauuaugguaauauggugguauguaugauuaacauggauugacu

SEQ ID NO: 2250059 - RNA, 68 nt, Homo sapiens
ccucaacucuaccuuaucccuaacuucccauuucaaauggaagggaauggggaucaaggaguagaagg

SEQ ID NO: 2250060 - RNA, 99 nt, Homo sapiens
gagauggagucuugcucugucacccaggcuggagugcaguggcaggaucucggcucauugcaaucuccaccucccggguucaagcgauucuccugccuc

SEQ ID NO: 2250061 - RNA, 86 nt, Homo sapiens
aguggacauccuugccuugugccugaucuuagggggcauguccuuuaaugagccacccugggaagucacauaguaucauuucuauu

SEQ ID NO: 2250062 - RNA, 79 nt, Homo sapiens
cuagccuauagaguugaguuuuagaagaagccuuucggauacugaaaacaaggcacugaacuuaaauucugcagacugg

SEQ ID NO: 2250063 - RNA, 86 nt, Homo sapiens
uuuagauaccucacguaaguggaauaauacaguauuuauucuucugugucuggcuuaucucacuuaccauguguccucuaucuagg

SEQ ID NO: 2250064 - RNA, 61 nt, Homo sapiens
ugggauaucauuauuucuagggcuuuucagugaaaaaagcuaggaaauauguauaucucca

SEQ ID NO: 2250065 - RNA, 84 nt, Homo sapiens
ccaaaccuaaugcuguuuuuaucauguugucuuaguagccuaucauuuuggugagauaacuaaaaacauuuugcggauguuugg

SEQ ID NO: 2250066 - RNA, 74 nt, Homo sapiens
aagggacuugacuugucucagaugagacuuuggacuuggacuuuuggguuaaugcuggaauaaguuaagacuuu

SEQ ID NO: 2250067 - RNA, 62 nt, Homo sapiens
ucaguagagacaggauuucaccauguuggccaugcuggucuugaacuccuguccucaauuga

SEQ ID NO: 2250068 - RNA, 62 nt, Homo sapiens
ucaccauuucaagugcugucuuagcugugacugguuuucagugacacuaaccacuuggguga

SEQ ID NO: 2250069 - RNA, 69 nt, Homo sapiens
cuugaacccaggaggcggagguuguggugagccaagaucacgccauugcacuccagucugggcaacaag

SEQ ID NO: 2250070 - RNA, 65 nt, Homo sapiens
gccccaugguugaacugagcccagauacagugaacaaggagagggguuacacaaccuaguggggc

SEQ ID NO: 2250071 - RNA, 76 nt, Homo sapiens
gguuaugcaaggcaugcaguacguuucuaugguaaauugcaaaccaagaacuuugacugaugucuucuuuuuaacc

SEQ ID NO: 2250072 - RNA, 62 nt, Homo sapiens
gcagaggcaguugaaugaugcguuugguggguggcagcaaaugcauaucaagauugcccugu

SEQ ID NO: 2250073 - RNA, 79 nt, Homo sapiens
uggcaauuaugugggaggacuuggcuguugacccagcaggguccacacugcguuuguccuuccagucucaaaauggcca

SEQ ID NO: 2250074 - RNA, 66 nt, Homo sapiens
agcuccuacuguuacaucauugauucauuaugaauuaaaaauuuuauaugcuguaagguaagggcu

SEQ ID NO: 2250075 - RNA, 94 nt, Homo sapiens
ggcaggauaaucgcuugaacccggaaggcggagcuugcagugagccaagacugcgccauugcacuccagccuugugacagagcgagacucugcc

SEQ ID NO: 2250076 - RNA, 71 nt, Homo sapiens
uggaagugagcugcagucugggguccaguguugagaagcagugcggacuuccaccgugcaccucuguuccg

SEQ ID NO: 2250077 - RNA, 60 nt, Homo sapiens
gugccucaggagacuauucagcaagcaacaauucugcuucagaguagcugucugaggugc

SEQ ID NO: 2250078 - RNA, 84 nt, Homo sapiens
cuuugggcuacuuucuucacuuuguuaaacuccaauuuccuuauauaugaauugaggguaaagggaagugauaaguucccaagg

SEQ ID NO: 2250079 - RNA, 87 nt, Homo sapiens
gaguuuugcucuuuuugcccaggcuggagugcaauggcgugaucucagcucauugcaaccuccgccucccagguucaagcaauucuc

SEQ ID NO: 2250080 - RNA, 76 nt, Homo sapiens
ugagaaaaauauucaagagauaauguuaagugcaaaaauagcauaagugagcaaaucuaugaauguauauuucuca

SEQ ID NO: 2250081 - RNA, 71 nt, Homo sapiens
cugauuucuuucacugucacaauuuccucaguuauaauuuugcaaaggcaguuucagugagaggugaucag

SEQ ID NO: 2250082 - RNA, 93 nt, Homo sapiens
cucucaucucugcuaccuuaucuccauugaaauggacauaaucaucucaaggugaaugugucaagaaaugugagguggagcugggauagagag

SEQ ID NO: 2250083 - RNA, 94 nt, Homo sapiens
gagccauaugcccaagguuuaugccauagcauugggugauuaagugagguagauuacugccuaaaguagugguuuaggcugggugcaguggcuc

SEQ ID NO: 2250084 - RNA, 79 nt, Homo sapiens
uccugucucuaacugaagugcuugccacauaaaaugaaugcaauauaauuuuauucagagagauuuuaagagauagaga

SEQ ID NO: 2250085 - RNA, 89 nt, Homo sapiens
guuuuaaucaagauugugccagaaaauuuacaggugcagauuaacaugguuaucugugaaugaaguuauuuugacagucauggggaaac

SEQ ID NO: 2250086 - RNA, 74 nt, Homo sapiens
guaauuagaguuuuuggcauuaagaugcuguauccauaucuggguuuuggcuagaaaugcuuaaaaucuauuau

SEQ ID NO: 2250087 - RNA, 90 nt, Homo sapiens
uaaugaccuugaccauuuugaggaguacugauuagguauuuuguagaauguccuuuaauugguauuuuucucauguuuuucuugugauua

SEQ ID NO: 2250088 - RNA, 72 nt, Homo sapiens
guccaugggaaauaguuauugagauuaauauuauuauuaugcuauugauuaauugugauuaggcagguggac

SEQ ID NO: 2250089 - RNA, 62 nt, Homo sapiens
cccugaucuugcccuucagaggguuugaggcugaaccagucccucuuugagggaagaaaggg

SEQ ID NO: 2250090 - RNA, 75 nt, Homo sapiens
cagaaauuuggauuuucaggaaguucuuggaacaaaguuauuugcaucuuuugcuuccuggaugagaauguucug

SEQ ID NO: 2250091 - RNA, 82 nt, Homo sapiens
acauuccuggagguauaauuauaggaucauugacuauuauaaggcugcuaaagcaugaugcuaaauuucuuuucaggagugu

SEQ ID NO: 2250092 - RNA, 77 nt, Homo sapiens
guauauucaaggaugccaauaaauguuaauaucuaaaauuggauugugauaauuguugcaaaacucugugaauauau

SEQ ID NO: 2250093 - RNA, 62 nt, Homo sapiens
cuucuuguuauccuguagcucauccaccgcaauggccccaucgcccggcugcaaacagggag

SEQ ID NO: 2250094 - RNA, 65 nt, Homo sapiens
aacccugugagagaguuaauauucaccccacuuuauggaugaggagacugaagcuuacaggaguu

SEQ ID NO: 2250095 - RNA, 114 nt, Homo sapiens
gugcaauaauuuuuaaggacguaugaauauggaguuuacuuaguguaauauuuguguuacacccacaaaaaauuccaaauugcagauguuuuauaccuuaaagcucuuugucac

SEQ ID NO: 2250096 - RNA, 63 nt, Homo sapiens
guauggcauguguuugaaugaguauacauuuauauguguaggguguucguauauguguuguau

SEQ ID NO: 2250097 - RNA, 64 nt, Homo sapiens
uuugcaggugguuuaugcaagacaauccauguuggaaaucgagucagcagaccaacucugcaaa

SEQ ID NO: 2250098 - RNA, 62 nt, Homo sapiens
uucuucaugcaucuuguggaauuugacugugaagcaaucuguuccaaaggauggauaaagga

SEQ ID NO: 2250099 - RNA, 101 nt, Homo sapiens
ugaggugagaggauugcuugagcucgggagguugaagcugcagugaaccgugauuguuucacugcacuccagccugagcaacagagugagacccuaucuca

SEQ ID NO: 2250100 - RNA, 77 nt, Homo sapiens
gcugggcauguaccugagagugaaguggaugguuucccaguuauccauuuguucagcuucaggaaauacugcccagc

SEQ ID NO: 2250101 - RNA, 77 nt, Homo sapiens
uugcuugaacccaggaggcagagguugcagugagccgagaucacgcuguugcacuccagccugggugacaagagcaa

SEQ ID NO: 2250102 - RNA, 76 nt, Homo sapiens
aaugagguccuguuauuugcaacaacaugauggaauuggagauuguuauguuauguuaaugauaauggaaaucauu

SEQ ID NO: 2250103 - RNA, 64 nt, Homo sapiens
uucaguuugccaguauuuuauugagaauuuuugcaucaauguucaucagggauauuggccugaa

SEQ ID NO: 2250104 - RNA, 76 nt, Homo sapiens
ccagcaucuggaacuuugcacaguagcuauuccugauuugcacaguguuccuacugugcaaaguugcaaauguugg

SEQ ID NO: 2250105 - RNA, 55 nt, Homo sapiens
aauguuuuuuugguguccagguaauaauguguggcacggaauucaaagaggcauu

SEQ ID NO: 2250106 - RNA, 83 nt, Homo sapiens
ggacccagugggaguuaauuuaaucauagggaugguuacucucaugcuguucucaugacagugagugagcucucacaaggucu

SEQ ID NO: 2250107 - RNA, 108 nt, Homo sapiens
gauauuucacauaaauggaaucauacguauguaguucuuuugugacuggcuucuuccgcuuagccagauacagccacauaauguaugauuccauuuuuaugaaauguc

SEQ ID NO: 2250108 - RNA, 90 nt, Homo sapiens
ugggccccacggacauuuuggcuggaucauucuuucuugcaggggcuuuccuaugcauugcagggugguuaacaaggucccuggccccca

SEQ ID NO: 2250109 - RNA, 130 nt, Homo sapiens
cucuaugggaucacccucuuuugcaucugacugaggcaagccuuaaagaucaagccgaugucagagcagaggaacugcuguuugguaaggaugccucagagaugaaaaggggaggaggguggucucagag

SEQ ID NO: 2250110 - RNA, 79 nt, Homo sapiens
caugugcauccgugugaagagaccaccaaacaggcuuugugugagcaacauggcuguuuauuucaccugggugcaggug

SEQ ID NO: 2250111 - RNA, 105 nt, Homo sapiens
ugccaguaugacugcauuaucuagacaauuccauccuacgugggcacucgauacaaagauacguccacagugguggaauuguucaggcagagcagcagcacggua

SEQ ID NO: 2250112 - RNA, 129 nt, Homo sapiens
ugaagauauagaacaaaaagcuggcauuaucagaacauguagacaacggacaaaguuaaggggcacaauauuuaacauugucauuuuucuaauguauuguuguaauguacauaacuuucuuugguguca

SEQ ID NO: 2250113 - RNA, 59 nt, Homo sapiens
acaggcccagcuggccaggacuuccuaucccugcacugagucacuggcccagggcuugu

SEQ ID NO: 2250114 - RNA, 94 nt, Homo sapiens
uauagcugcuuaggacuugggaguguguaggacccagugugagccucuuuuguggaacaguguguuuacacagucaacaaggcagguuucuaug

SEQ ID NO: 2250115 - RNA, 64 nt, Homo sapiens
cuugugacagugaauaagucucuuaagaucugaugguuuuauacagggaguuucccugcacaag

SEQ ID NO: 2250116 - RNA, 70 nt, Homo sapiens
guggaagacaguggcuuuuuaguggcagauguucacucaucucacuucugaaaggcccuccauugaccac

SEQ ID NO: 2250117 - RNA, 127 nt, Homo sapiens
ucuccucuuuuuuccuuuuuucuacccuuaaguuucuguggggccuuaaauucugugagcugcagaaggacucucuccacagcuguaaauauaggggacgugggagagagaaagaaaaaaggagaga

SEQ ID NO: 2250118 - RNA, 63 nt, Homo sapiens
ucuuuaucuuccuccuuuaguuuacuugaaaauuuaaugugaacuguuugaggaagagaagga

SEQ ID NO: 2250119 - RNA, 62 nt, Homo sapiens
gcccgggaggcagagguugcagugagcugagauugcgccauugcacuccagccuaccugggc

SEQ ID NO: 2250120 - RNA, 57 nt, Homo sapiens
gcuuaggaugaucauggaaguuuuccuguuggagcaguagcuagccauggucaaggc

SEQ ID NO: 2250121 - RNA, 66 nt, Homo sapiens
ucucacauucaauuguaauccccgauguuggaguagggccugguggaaggugauuggaugacgggg

SEQ ID NO: 2250122 - RNA, 66 nt, Homo sapiens
ccagccaagcucagacggauccgaugaucuuucugaaucagagcccucugagcuucagcaggcugg

SEQ ID NO: 2250123 - RNA, 92 nt, Homo sapiens
ggggccuggggagcgugguggcacugagcaagcucacaaaggccucugugucgccuggcagcucaggccccgcgcugagggcccugggcuuu

SEQ ID NO: 2250124 - RNA, 62 nt, Homo sapiens
gcacagguugcaaaaguucacauuuuagcuaacauguuuugugaugcuuuucuuaaccuugc

SEQ ID NO: 2250125 - RNA, 58 nt, Homo sapiens
gaggggcagguaccaagacuagaaaggcaccuggaaaggguguuugguucugcgccuc

SEQ ID NO: 2250126 - RNA, 87 nt, Homo sapiens
ccccaguguccucguauccuguuuagcucucccacgaucuaacccaguccucuguggaccaggcuuauaggauauggucaacugggg

SEQ ID NO: 2250127 - RNA, 85 nt, Homo sapiens
cugggagcucauuaaaaauguagaaucucagaucucaccccacaccuaaugaauccgaaucugcccuuuauacugagcuccccag

SEQ ID NO: 2250128 - RNA, 77 nt, Homo sapiens
auauuuuuccaugaacuagaauagaacaugggcaaauuuucaaccucaugucccuaucuugguucacugaaagguau

SEQ ID NO: 2250129 - RNA, 76 nt, Homo sapiens
gggaauugagauagaauaggaaugggaugcaacuccuccuucacauauguuuucuucucuuuuuuucucucguccc

SEQ ID NO: 2250130 - RNA, 57 nt, Homo sapiens
cauuuauucauuugcuagggcuagaggcuuagcacagucccuggcacauggaaaaug

SEQ ID NO: 2250131 - RNA, 111 nt, Homo sapiens
ccagaccucugaggagggggagcugccuggcagaggcuggugccucagaagcuaagaagagggucuuauguaacugggacacaagccucugaggguagcaucagaggcugg

SEQ ID NO: 2250132 - RNA, 63 nt, Homo sapiens
gcuuaagggaauguuguggcugguuugaucuguucagaccaccaaaacuuucuccauaucagc

SEQ ID NO: 2250133 - RNA, 67 nt, Homo sapiens
gugagguaagaguugcuuugcuaaauguauguugcccuucaaggcaauuagggcugcucuggcuuac

SEQ ID NO: 2250134 - RNA, 59 nt, Homo sapiens
gguuuuccuaguaggccuauuagaaucacaggauucuaguaaugagaggcaggagaauc

SEQ ID NO: 2250135 - RNA, 64 nt, Homo sapiens
uuuggaugugguagugcugaucagggccaugugcugauguccuggagagcaaaaucaauccaaa

SEQ ID NO: 2250136 - RNA, 65 nt, Homo sapiens
augguguugggagaacuggcuagcaauaugcagaaaguuggagcuggaccccuuucuuacaccgu

SEQ ID NO: 2250137 - RNA, 68 nt, Homo sapiens
aaggcuagagaagaagggcaucccagcuuuggaagacagaaagcaagaauucucuccuccucugccuu

SEQ ID NO: 2250138 - RNA, 76 nt, Homo sapiens
uuaggcuagcccuuaaauucuuaaugcccucauuuauaaagugagcauaacaacagaguuuagcucguugggcuga

SEQ ID NO: 2250139 - RNA, 77 nt, Homo sapiens
auauugcaucuuugagcauuagggcaaaggcaagacccucugcuccuugucugcccuaaugcucaaagaugcaauau

SEQ ID NO: 2250140 - RNA, 55 nt, Homo sapiens
ggauccuuaacuaucacagugaggaguacugauuauaacuggauguaaagggucc

SEQ ID NO: 2250141 - RNA, 57 nt, Homo sapiens
gcucuuuugggguaauucugagcaaguuugccaaguucacaaccaucccaggggagc

SEQ ID NO: 2250142 - RNA, 72 nt, Homo sapiens
gucgucgccggccuggcggagggucagguggaccacagguggcaccgggcugagcgcaggccccgcggcggc

SEQ ID NO: 2250143 - RNA, 64 nt, Homo sapiens
ugaguaugaguucaggaaaggcuuucuaagaagguauuauuuaacuucugggcauucauauuua

SEQ ID NO: 2250144 - RNA, 101 nt, Homo sapiens
guggugccgucuugccucacuucaacugcucacuccuggguucaagcaauccuccugccugagccuaccgagcagcugggauuacaggcaugcgacaccac

SEQ ID NO: 2250145 - RNA, 65 nt, Homo sapiens
uagcugguucuccaggagcuaggaucagcucagccuggcaccuaguuagcaggaggaaucaguua

SEQ ID NO: 2250146 - RNA, 55 nt, Homo sapiens
ucuuauauuaucuuauauuuucugggaacuguccauaauuguaagauguauggga

SEQ ID NO: 2250147 - RNA, 121 nt, Homo sapiens
guugaagguugguagaauuaaguggccuucagggcuuuugagcugagaugguguuaacaauguuggcuucagcaucaaaccauccacucgugagcuuuggcaucuuaaaugagucuuuaau

SEQ ID NO: 2250148 - RNA, 60 nt, Homo sapiens
ccaguuuagagcaacaguaacuggggaucuggugaacuccacugugguaucugauacugg

SEQ ID NO: 2250149 - RNA, 73 nt, Homo sapiens
ggauucaguuugccaguauuuuauugaggauuuuugcaucgauguucaucggggauauuggccugaaauuucc

SEQ ID NO: 2250150 - RNA, 58 nt, Homo sapiens
agaaccagucagcaugucccagcacaugcucagagaggaacacaugagacuggauucu

SEQ ID NO: 2250151 - RNA, 74 nt, Homo sapiens
ugguuuuguuauguaguugcucugccuguuuuuauguagagauuaauagagacuagccaacuauguuccugcca

SEQ ID NO: 2250152 - RNA, 95 nt, Homo sapiens
gggcugauucuuaucuuuagaaauuuuaugggagcuauuuuggcucugcuugggaaaguuuugguugaguuacuagcaguaugagaaucuagucc

SEQ ID NO: 2250153 - RNA, 67 nt, Homo sapiens
uauucucuaggacuuuuugguaggcgggagagaaccuucccucuauuuccuuaaaauccugagggua

SEQ ID NO: 2250154 - RNA, 66 nt, Homo sapiens
uacuuuucuaaagagcuugugucagugucauuuaacaauaauuauuagcccaucuugaggaaagua

SEQ ID NO: 2250155 - RNA, 69 nt, Homo sapiens
uaugauuuuugggagaggucaaggguggaauuauauaguauggauauuugucucugcucaaaucucaug

SEQ ID NO: 2250156 - RNA, 76 nt, Homo sapiens
aaugagauaaucuggguaaugcauuuagcauauggcuggcaugaaguuaagugcucaguuacucaguuauuauauu

SEQ ID NO: 2250157 - RNA, 84 nt, Homo sapiens
ggaaacaccuaaguauuuuccugagcaucuggauaauuuuaaauauacauaauucaacuacuuagguaggugccagguuuuuuc

SEQ ID NO: 2250158 - RNA, 97 nt, Homo sapiens
ggaaaauuuaaaucuuguugugagaauauuuuaaauacuaauguucccccugcuauguugguguuacaauucucaauaggaaaugauucagaauucc

SEQ ID NO: 2250159 - RNA, 130 nt, Homo sapiens
agucuccaugacugugagccaauuaauuucuguuuauauuaguccauucucaugcugcuaugaagaaauucuugagacugguuaauugauaaagaaaacagguuuaauugacucacaguuccauaugacu

SEQ ID NO: 2250160 - RNA, 94 nt, Homo sapiens
aauaucacagaguguacacccacugugauauuaggagaaagcucucccuuggguauuagaauaauaucacaggguguacacucacugugauauu

SEQ ID NO: 2250161 - RNA, 72 nt, Homo sapiens
cauugcacaacucugagaagcacuaucuaugugguauucuaugugaauggugcuuccuagauguguacaaug

SEQ ID NO: 2250162 - RNA, 60 nt, Homo sapiens
cuggaaugugagccccaaaaaggcagacgcugucaguuuuguucauugccacaucucuag

SEQ ID NO: 2250163 - RNA, 66 nt, Homo sapiens
ggguauugucaccaucccuguuuuauacauaaggacagugguaaggcucagagaggugaaguaccc

SEQ ID NO: 2250164 - RNA, 75 nt, Homo sapiens
cucagaauuucauacuguccaauucuaguggccuugcaaccuggcaggcaacuugagugaggcaagugugcuggg

SEQ ID NO: 2250165 - RNA, 60 nt, Homo sapiens
uagguuuuuugcagagagauccacuguuagugugaugggcuucccuuuguagguaaccug

SEQ ID NO: 2250166 - RNA, 58 nt, Homo sapiens
uauuuggaaacaauucacaugcuuuuucugucuuuguaggcaugugaauguucaaaua

SEQ ID NO: 2250167 - RNA, 83 nt, Homo sapiens
ggauggcuugagcucaggagguggagguugcagugagccaagaucgcgccacugcacuccagccuuugcgauagagccagacc

SEQ ID NO: 2250168 - RNA, 55 nt, Homo sapiens
gagaauggaguagaacugacaauuagaccuaucugucaugagucuccuccaucuu

SEQ ID NO: 2250169 - RNA, 57 nt, Homo sapiens
cuuggacaccucaugcccaccugcucuccccugugcagaggguaccugaaguccagg

SEQ ID NO: 2250170 - RNA, 69 nt, Homo sapiens
uuguauguuuaaggccaguggaaucuauagcuaauuacucauuugguucuugaaaacugaaacaugcaa

SEQ ID NO: 2250171 - RNA, 79 nt, Homo sapiens
uguccuucagucuaucagacuuguuuauaguuuuauuguuugaaauagagaugauuaacauuuugguagaaugaagacg

SEQ ID NO: 2250172 - RNA, 57 nt, Homo sapiens
gcuaaaauauuugggcuuugaucuguaggcgauuagagccauugcagauguuugagc

SEQ ID NO: 2250173 - RNA, 69 nt, Homo sapiens
aagcuguguguaagcucucacacuccuuugcaauguuauuucucagggguguguuguaucuaucaguuu

SEQ ID NO: 2250174 - RNA, 73 nt, Homo sapiens
ugggaggugacccuguugucagaauguggaugggugauagccaaugcacaggcucacacacagcucaagccca

SEQ ID NO: 2250175 - RNA, 93 nt, Homo sapiens
gucaggaggucucucagcucucuaaggucuugcuuuuagcucuaacagagaggagguaggggccuuaaagaugcaugggagcccccuuuuggc

SEQ ID NO: 2250176 - RNA, 104 nt, Homo sapiens
ccccaucacgggauugucgacuucaucaaauccacaagaccccuuuucacugugaaguaauauagucacagguucuugggauuagaggaugaacaucucugggg

SEQ ID NO: 2250177 - RNA, 56 nt, Homo sapiens
cagggugccugguuguuaagauuguagaagcuuuuacagugggcacuggcgcccug

SEQ ID NO: 2250178 - RNA, 56 nt, Homo sapiens
cugaagcacaccuaggcugaaggaauucuuguucuuuggucucugguugacuucag

SEQ ID NO: 2250179 - RNA, 120 nt, Homo sapiens
ucuguuuucaaucuuucaaaagacaugugaaaaaugaaguuggccugagguuugaggcagauguuuugacugauuugugcucaucucagucaacuguuuucucaagggguugggagcaga

SEQ ID NO: 2250180 - RNA, 58 nt, Homo sapiens
gacacgcugugacaguccagccaucaguuuugccgaugaacuggaugucgaguguguu

SEQ ID NO: 2250181 - RNA, 78 nt, Homo sapiens
auaggguuuuugguuauauauauacacucuuguauuaacauagagugucaauauaacucaaagaaugcaagacccuau

SEQ ID NO: 2250182 - RNA, 62 nt, Homo sapiens
aagucuaagcauucacaaggcacuugaguacuccaacuuuuaagguuuuuagugcuugacuu

SEQ ID NO: 2250183 - RNA, 121 nt, Homo sapiens
guuugagugauacgaaccgucuccucucccggguagaauguaacuuccaugucauggguaaaggcagcaccuggagaugaaaaacauucagcacagggaugaaaagaggucuugcuuaaac

SEQ ID NO: 2250184 - RNA, 88 nt, Homo sapiens
uguggauuuuuuuuccuuggagauagggacccuguuuuagauacuauauuuuauuuccugucuuccaagagagauuuaaagauuuaua

SEQ ID NO: 2250185 - RNA, 56 nt, Homo sapiens
gucacggaaaagguugugugagccccuugaggcauuuauccagcacuguuucggac

SEQ ID NO: 2250186 - RNA, 66 nt, Homo sapiens
aagggucagcuugagaccuugaggaguuuuuuacaccgacuuuggagcucguuuuugcugacucuu

SEQ ID NO: 2250187 - RNA, 61 nt, Homo sapiens
ugacugucauaugugaauauccagccagaguugaaauggcuagauauucacauauggcuca

SEQ ID NO: 2250188 - RNA, 69 nt, Homo sapiens
aguaauggcaccugacuccgagaugcagaagcaggaaauauuucugacaugcggcucaaguccaauauu

SEQ ID NO: 2250189 - RNA, 69 nt, Homo sapiens
acucugguccaguuauccuguggggaggagacccuuagucuccuguccuuggaggcugggucccagagu

SEQ ID NO: 2250190 - RNA, 76 nt, Homo sapiens
uaggcaaggccuaaucauacugcuaagugacacauaguauaggugcuauuagauguuugacugggccuuaugucua

SEQ ID NO: 2250191 - RNA, 77 nt, Homo sapiens
ccggggcuucagagcauugguuuuuugaauguaauuuuucuaauccuugccauccaaagagauguguuuugcccugg

SEQ ID NO: 2250192 - RNA, 58 nt, Homo sapiens
uugagacagagucucacacuauugcccaggcugcaguggugcaaugaagugaucucaa

SEQ ID NO: 2250193 - RNA, 62 nt, Homo sapiens
guucccaccuuguuuguucuguggcuuccaggagggaagacuuggaccagagagguggggac

SEQ ID NO: 2250194 - RNA, 61 nt, Homo sapiens
cugguaaccaucgagcaaaaguagucgauaaaaguguuauugcuaaaacucaugguugcag

SEQ ID NO: 2250195 - RNA, 83 nt, Homo sapiens
gauuccaauggaccaauauggcuugugacccaugcuucauuuaccuaaaugaggccacaaggcucugugaucacguggcaguc

SEQ ID NO: 2250196 - RNA, 102 nt, Homo sapiens
cugaggcaggagaaucgcuugaaaccagggggcggagguugcagggagccgagauugcgccauugcacuccagccugcugacagagugagauuccgucucag

SEQ ID NO: 2250197 - RNA, 92 nt, Homo sapiens
cuucuagaaaucaugauccauuuagagucuugcaauuuuaccaagcagagugagugaaaugccuugagauuuugacucgucuuuucaagagg

SEQ ID NO: 2250198 - RNA, 63 nt, Homo sapiens
uuuuuguuacaguugccuacuauucuugcacaagggauacuggcuuuccaauugugauaaaga

SEQ ID NO: 2250199 - RNA, 57 nt, Homo sapiens
cuucauggugguacaaaagcaauacacauucaguacgcuccuugacucacuaugggg

SEQ ID NO: 2250200 - RNA, 60 nt, Homo sapiens
uuauuagguugguggaaaaguaauugugguuuuugccauuacuuuugcacaaccuaauaa

SEQ ID NO: 2250201 - RNA, 83 nt, Homo sapiens
ugauacguuuugaguagaggaggaacuugauucugauuuaacauuuuauagaucacucagguuucucccuggggacuagauua

SEQ ID NO: 2250202 - RNA, 58 nt, Homo sapiens
ugccaggaugaggucaauguuugguuacugaugagaacaaacaggccucaguccugca

SEQ ID NO: 2250203 - RNA, 74 nt, Homo sapiens
aggaugacagggaaacauugaaguguccuuaguagaggagugacauuaucagguuuguuuucuagcuuaauucu

SEQ ID NO: 2250204 - RNA, 57 nt, Homo sapiens
cucuuagauuagccauccuaauauccauucuggaauuaggccugcagaaucaaagag

SEQ ID NO: 2250205 - RNA, 105 nt, Homo sapiens
gcauuauaagaagauaggaaagacauauggcaaaauguuccuagugguuauugagauaaccacuggauagugaaauuuucuguaauuuuuauuucuucuuggugc

SEQ ID NO: 2250206 - RNA, 82 nt, Homo sapiens
auaauauuccauugucuagauguaacacaguuuauccauucaccuaaggacaugcuguuugcauccagguuuuggcaauuau

SEQ ID NO: 2250207 - RNA, 64 nt, Homo sapiens
uucuuugcaugaucucaaagucacugauaugcaggagcucaccaaguugagacugugcagagaa

SEQ ID NO: 2250208 - RNA, 81 nt, Homo sapiens
cagucccagugagaugaaucagguacuucaguuggaaaugcagaaaucacccaucuucuguguugaucacacugggagcug

SEQ ID NO: 2250209 - RNA, 74 nt, Homo sapiens
agcauggacuauacuguuauugaauuagauggcaaagcauuagguuuauuaugcaaugacacuguagcugugcu

SEQ ID NO: 2250210 - RNA, 61 nt, Homo sapiens
gcaucacugggagcagccauuaauaauacaaacauuuauucuugguguucuccaguaaugc

SEQ ID NO: 2250211 - RNA, 111 nt, Homo sapiens
cagaucaucaggcauuagauuaucuuaaggagcaucaaccuagaucccuugcauggguaguucacaguaggguucaugcuccuaugagaaucuaaugccacuacugaucug

SEQ ID NO: 2250212 - RNA, 68 nt, Homo sapiens
ggggguguguaugaacugaaggagcagaaucauuagcgagcagguuugagucauuggugagcaccucc

SEQ ID NO: 2250213 - RNA, 129 nt, Homo sapiens
cgggacucuuggaggaggcucaaggaaagaaaucagcaugcagaagucgggggagguggccaaccugaccagacgccucugauccugcaucuccuuugcccuaucuaaaguccuccccaacacugccug

SEQ ID NO: 2250214 - RNA, 64 nt, Homo sapiens
cugcuaccuugcacuucauguaggccaaagcaggaaugugguccuaagacugaagugcaggcag

SEQ ID NO: 2250215 - RNA, 100 nt, Homo sapiens
gagguaggagaaucgcuugaacccaggaggcggagguugcagugagucgagaucuugccauugcacuccagccucggcaacaagagcgaaacuccaucuc

SEQ ID NO: 2250216 - RNA, 68 nt, Homo sapiens
ggguugccauuuuaaauagauuggucaaggaaugccucuugaagaaaguaccauuugacaugggaccc

SEQ ID NO: 2250217 - RNA, 129 nt, Homo sapiens
uccuuuguaagcuacucagucuugggcaugucuuuauuagcagugugagaacagacuaauacaguaaauugguauuagguagugagaugcugcuguaaagauacccaaaaauguggaagugacucugga

SEQ ID NO: 2250218 - RNA, 76 nt, Homo sapiens
cuggauacaggauagacaauuuauuaaggagucuauuuacuugacaaauaacuuacugaguccuguucugugcuag

SEQ ID NO: 2250219 - RNA, 79 nt, Homo sapiens
acaucuuuuugcaauuugugaauauugugauccagccauguucacaggccauuugggauaaucacaaaguaaaacaugu

SEQ ID NO: 2250220 - RNA, 78 nt, Homo sapiens
ugaggauuacaauucaacaugacauugggguggggauacagagccaaacuauaucaccauccucauugucaauccuca

SEQ ID NO: 2250221 - RNA, 57 nt, Homo sapiens
cucuaaagggaagugcguucuuuucuuuuagacaacagaaaguucuucccuuuggag

SEQ ID NO: 2250222 - RNA, 92 nt, Homo sapiens
gucauccaggagcugugagaaaugcagaaucucaggccccagcccagaccuacuggauuugagucugcauuuuggcacaguccccaggugau

SEQ ID NO: 2250223 - RNA, 62 nt, Homo sapiens
gcuugugacacuggagcuggcacaauuuuggaggagaauguaguauuaccuaguucacaggc

SEQ ID NO: 2250224 - RNA, 88 nt, Homo sapiens
ugggaccaccauuguauaugcgguccaucacugaucaaaacguuguuaugcagugcaugacuguauauuaucacaugugaucuuccca

SEQ ID NO: 2250225 - RNA, 59 nt, Homo sapiens
uuuuagcuuuucccaggacuccucuaaugacaacuccggaguuuucccugaagcuaaag

SEQ ID NO: 2250226 - RNA, 99 nt, Homo sapiens
ugcguacauuauguguguacacccccucugagguuauucguaauauucuaggggaauguugcugcuaaugucacagggagaguacaccauguguaugca

SEQ ID NO: 2250227 - RNA, 55 nt, Homo sapiens
uuuucuuuccauacauauugcuaucacuucggugaugguaauguaagagaggaga

SEQ ID NO: 2250228 - RNA, 63 nt, Homo sapiens
gccaaagaaaagugucuguuccuagcaugaggaaaccuuguuaagaaaagggcauuugauggc

SEQ ID NO: 2250229 - RNA, 84 nt, Homo sapiens
ugcauccucaucuucuuuuaguggaauauuuacaguuucuucagcuggacuaucaaaucuuucacuagucaguuguuggaugca

SEQ ID NO: 2250230 - RNA, 57 nt, Homo sapiens
ggcugcauggucuggaaguucaccugggugucugacuucaucauacuauguguggcu

SEQ ID NO: 2250231 - RNA, 127 nt, Homo sapiens
gugauccgcccgucucggccucccaaaguccugagauuacaggcaugagccacugugcccgaccgggcaugaugucuuaugccuauagucccagcacuuugggaguucaaggcagcaggaggauuac

SEQ ID NO: 2250232 - RNA, 63 nt, Homo sapiens
auggccuaugaccguuauguugcuauaugcaaaccucuccacuacaugacagucaugagccgu

SEQ ID NO: 2250233 - RNA, 79 nt, Homo sapiens
uugguuuuuuguccuugagauaguuugcagagaaugaugguuuaaauuuuugcaaucuacucaucugacaaagggcuaa

SEQ ID NO: 2250234 - RNA, 60 nt, Homo sapiens
agauugaugaagaucaugauugacgauugaaaaguugacaagauauggucuuaucaaccu

SEQ ID NO: 2250235 - RNA, 71 nt, Homo sapiens
cauauucaguggguauuaugugccagacauugcuacaagcauuuggcaguuauuuacucagugaucauaug

SEQ ID NO: 2250236 - RNA, 56 nt, Homo sapiens
ugggaacaugaagguuaaagagagaaggucaaguuccucauuuaaccgugauccua

SEQ ID NO: 2250237 - RNA, 65 nt, Homo sapiens
accagaguuguuugguugaguauggaaguuauguaaguuaacuuaugccacaccagaugucuggu

SEQ ID NO: 2250238 - RNA, 67 nt, Homo sapiens
uuuugaggucuuggaagaaguugcaccaguaugagaauagugggucaguuuucuccaggauccagaa

SEQ ID NO: 2250239 - RNA, 68 nt, Homo sapiens
ggguacaugugcacaaugugcagguuuguuacauauguauacaugcgccauguuggugugcugcaccc

SEQ ID NO: 2250240 - RNA, 64 nt, Homo sapiens
auugugaauagugcugcaauaaacauaugugugcaugugucuucauagcagcaugauuuauaau

SEQ ID NO: 2250241 - RNA, 86 nt, Homo sapiens
cuuuauuucuggcuuugccuuugugauauggucuaucagaugauugauaaaaucuaucuagaguaaggauauaagacaaaauaaag

SEQ ID NO: 2250242 - RNA, 83 nt, Homo sapiens
gagaaucacuugaacccaggaggagguugcagugagccgagaucaugccauugcacuccagccugggugacacagcgauacuc

SEQ ID NO: 2250243 - RNA, 127 nt, Homo sapiens
uugauuaauuuguuuuucuuucucaugguucugacacuuaggagauauuuaaauugcauuuuacaacuuugugcaaaaccaguccgaguguuagagagcugugugggcagaauuuagauguuuuuaa

SEQ ID NO: 2250244 - RNA, 60 nt, Homo sapiens
uuuugguauccccaagguggagagggggcuccugugaccaauccccuguggauaccaaga

SEQ ID NO: 2250245 - RNA, 60 nt, Homo sapiens
aacugcguuuucacucaacagcauuuguuuaccagaugcuauguagaugagggcccaguu

SEQ ID NO: 2250246 - RNA, 63 nt, Homo sapiens
aggguaacuuucugacauagccauggcauuuguaaacugucauggcacugauggaaguaccuu

SEQ ID NO: 2250247 - RNA, 57 nt, Homo sapiens
ugcauggauguuugaacacacugugcuguggaugguguucuuaauaacaucccugca

SEQ ID NO: 2250248 - RNA, 98 nt, Homo sapiens
aauuuuauaggaccccggaaaauugauugaggaagaucuaaaagaaaacaauggucaaauuuuguucuuuaguucacuugcuccagguccugaaaauu

SEQ ID NO: 2250249 - RNA, 76 nt, Homo sapiens
uucucaaacaggggugacuuugucccccaggagacauuugggaaugucuggagacuugggucaucaaaacugagaa

SEQ ID NO: 2250250 - RNA, 75 nt, Homo sapiens
cagaaauuggacaguaaggcuaccgugguaaaagaaguguuaaaauacuugcaguacuuuauguccuaauuacug

SEQ ID NO: 2250251 - RNA, 57 nt, Homo sapiens
uuggccaguauuuuacugaggauuuuugcauugagauucaucagggauauugguuga

SEQ ID NO: 2250252 - RNA, 115 nt, Homo sapiens
uucuggugccuucccuugaagcagucugggguauugcacacagaaucaggguaagggauuuggcuuccccuguguguaagugcgcuaggcccauuguaagcagagagcaguggaa

SEQ ID NO: 2250253 - RNA, 89 nt, Homo sapiens
ggggagaguuggagacagugucagccauugaaaagaccaaacaauuuaaggcccuuuuccccugggaacauugauucuuuaaucucccc

SEQ ID NO: 2250254 - RNA, 59 nt, Homo sapiens
cucaucccuguguccagcaccuguguuccucagggagccacaggggccaccagggagag

SEQ ID NO: 2250255 - RNA, 129 nt, Homo sapiens
ugcaagcauuuucaaggaaaggaauguuuguuacaggugauugucuaaucaagauacauuugaaauguauccuuuacuggauagcaacuguaaacaauauuuaaaaaauauaucucagagugacuugca

SEQ ID NO: 2250256 - RNA, 72 nt, Homo sapiens
guucugucacaguuuuggaggccaguagucugaaaucagugccgcuggcccaggucaagaugugagcagggc

SEQ ID NO: 2250257 - RNA, 95 nt, Homo sapiens
aaguucccauggucaaguaaguuuggaaaguuugaguuaaauaagucacucugcuacaggacuucucagaguuauucaugaucgaaugugaauuu

SEQ ID NO: 2250258 - RNA, 77 nt, Homo sapiens
uuuguuuuguuuugagauggagucucgcucuguugcccaggcuagagugcaauggcaccaucucggcucacugcaaa

SEQ ID NO: 2250259 - RNA, 82 nt, Homo sapiens
ugcagguuuguuauguagguauacaugugccauggugguuugcugcaccuaucaaccugucaucuagguuuuaagccuugca

SEQ ID NO: 2250260 - RNA, 95 nt, Homo sapiens
gagaaauuuccccuuggcugucuuguuucauggauucguggaaacucccauuaaacagccggucacagaaaaagauaugccaaggaaaauuacuu

SEQ ID NO: 2250261 - RNA, 84 nt, Homo sapiens
caaagagaaggagaaaagagcuguggcccuucagggagcccagaccuagggacucccugagccagggcuuugacacccucuuug

SEQ ID NO: 2250262 - RNA, 65 nt, Homo sapiens
gugugagcagaguuguuucuccugaggccccucuccuuggccugcagauggcugcugccucacau

SEQ ID NO: 2250263 - RNA, 57 nt, Homo sapiens
aagaacacuagcggcguugaaagcuuuuaugcagcuuucuacuccggcguuguuuuu

SEQ ID NO: 2250264 - RNA, 77 nt, Homo sapiens
ggcuauuaugcagauauuuuugugguugcuuaacagugucacuggucuguguacuuaagaguguuuucauaguggcu

SEQ ID NO: 2250265 - RNA, 62 nt, Homo sapiens
ugggaaauuagauaguacugaaugguucuggagaaggaccaggccuguacucugaacuccua

SEQ ID NO: 2250266 - RNA, 90 nt, Homo sapiens
auuuuguuaggacacauugcaggaaaguucauuauucuaggccuucaacagaauaaucuuagcaaccuccagugugauagagaacagagu

SEQ ID NO: 2250267 - RNA, 84 nt, Homo sapiens
cuuuaacugcagccaaggcaugcugaguccuaaaagggagguuauuuccuugagggacucuaugacuuaguuuaacaguuggag

SEQ ID NO: 2250268 - RNA, 77 nt, Homo sapiens
uacugggcaccuguuauauguuuggaaugaggaaauagaccauuucuuuaugaugcauauaaucugggaagacagug

SEQ ID NO: 2250269 - RNA, 90 nt, Homo sapiens
uauauauuuucaugaccuuaaaauuguucuacacuguuaugauagugagucuauggcuguaaggauaguaaccuguuauggggauacaug

SEQ ID NO: 2250270 - RNA, 57 nt, Homo sapiens
aaucugaguguggccugugcagauaguaguauugugacaguguuacauuucaugauu

SEQ ID NO: 2250271 - RNA, 98 nt, Homo sapiens
ucauaccuauaauaauuggcaauguuaauugaguauuuacuaugugccaaguucuguacuaagugcuugacuuugauguuuuauuuauuuauuuauga

SEQ ID NO: 2250272 - RNA, 103 nt, Homo sapiens
aggugacuaaauuugcaucuuuuugguguauauguaaacuaugcauguuucuuuaaugaagccaugguguuuauuuauaccauuuggaauguauucugcaucu

SEQ ID NO: 2250273 - RNA, 70 nt, Homo sapiens
gcucuuucgcugggcuccgugacuggcuguucuguaaggucugguuugcuaucagagccggugaaagggc

SEQ ID NO: 2250274 - RNA, 63 nt, Homo sapiens
caugcaaauagcacaugugcaaauggcugugugugucuccauacacacacauguguauguaug

SEQ ID NO: 2250275 - RNA, 87 nt, Homo sapiens
agagguuuuguuuuguuuugagcuagagucucacucugucgcccaggcuggagugcaguggugagaucucggcucacugcagccucu

SEQ ID NO: 2250276 - RNA, 93 nt, Homo sapiens
aggagaguaugaugugugaaaggugaaagauuaaaccagugugucuuacugacagauugcaagauuuuuuaucaaucagcauguauuacuucu

SEQ ID NO: 2250277 - RNA, 104 nt, Homo sapiens
auauaccuaaguaugggacaauuauaugaaacugccaguauucaacuggcauugaccuacaaauggcaguuuggcaguuucauaaaguucaaacuaagauaugu

SEQ ID NO: 2250278 - RNA, 56 nt, Homo sapiens
aggcuguagugcaugugcuaugaucaugccugugaauaaucauugcacucuagccu

SEQ ID NO: 2250279 - RNA, 115 nt, Homo sapiens
cuuccauuuagaacuauuagguuggugcaaaaguaauugcaguuuugccacuuuuguuggcaauauccacaauuacuuuugcaccaaccuaauacuauuuuguucaauauagaag

SEQ ID NO: 2250280 - RNA, 56 nt, Homo sapiens
guugguucuguuuauaugcuggauuacguuuauugauuugcauauguugaaccagc

SEQ ID NO: 2250281 - RNA, 120 nt, Homo sapiens
caauguauacauauaucaaauuuuaccccauauuguacauuggguacaaucuguacccucauaauacaaauuguaccccaauguacaauauggggagcaauuugauacauguauacauug

SEQ ID NO: 2250282 - RNA, 69 nt, Homo sapiens
ggagauuauuaguguuucaugccugcuaacauaaauccuuucugcagcucaugaaucagacuaauuucu

SEQ ID NO: 2250283 - RNA, 56 nt, Homo sapiens
uugagauggaguuucgcucuuguugcccaggcuggagugcaauggcaccaucucga

SEQ ID NO: 2250284 - RNA, 62 nt, Homo sapiens
caaugguccccauuggcaggaacugaacccuucucuccucuccuuucuccgggggacuguug

SEQ ID NO: 2250285 - RNA, 103 nt, Homo sapiens
cauauaaugaaacgugguuuuguuauuguuguuguuuugccucagcaacguuauaaggaaaugacauugagcaaaacauuaauauuagaggaccuguuauaug

SEQ ID NO: 2250286 - RNA, 71 nt, Homo sapiens
uugugucuuacugaguugauugucuuagaaacauauaaacaugacuaugagaccagcuucagaaagcacga

SEQ ID NO: 2250287 - RNA, 81 nt, Homo sapiens
guaguggcaauaauuagaucaacuuugguaagagaaagcuuauguuuuugggcuaaaacauggucucaccccugccacuau

SEQ ID NO: 2250288 - RNA, 95 nt, Homo sapiens
gaaggaauacucauggcaguggugauaaccgcuaucauagcuaccauaaaauuacucguugugacugguugucccgcuuuccucagguuuucuuc

SEQ ID NO: 2250289 - RNA, 77 nt, Homo sapiens
ugaagauuauuucaaaacuggcacuacaucaagagcuucuggaagucuggauaguuucaguuugggaaauaacuuca

SEQ ID NO: 2250290 - RNA, 63 nt, Homo sapiens
ggguugcaugggagcugggugaagccuguaacugcuggcuuucccccacuucccugacaaucu

SEQ ID NO: 2250291 - RNA, 64 nt, Homo sapiens
aaagaauaguagaccaaagaguguacaacuccauguguuugugcgcaucggggccugcuucuuu

SEQ ID NO: 2250292 - RNA, 69 nt, Homo sapiens
ucaucucuugccagucagaauggugauuauuaaaaaguccagaaacuauagaugcuggcgaggcugugg

SEQ ID NO: 2250293 - RNA, 102 nt, Homo sapiens
agaaggggaagaaagagaagcaggauaggguauccuuaacaauacuuaaguuuguaaagaucauaugcuguucuauuuacaauucuuacuuuaugaacuucu

SEQ ID NO: 2250294 - RNA, 80 nt, Homo sapiens
uaacagcuggaggugcuuaacuuuggcccugcaucaguuuucaaaagugcauaaagguaagcacuauccugaaacuguug

SEQ ID NO: 2250295 - RNA, 78 nt, Homo sapiens
gggcacugccaagaagugucuaagcaggaggugcugugguccagucugcacuucggagacauucucuuggcauagccu

SEQ ID NO: 2250296 - RNA, 56 nt, Homo sapiens
uguuuccucaugaugaugucauuuucauaaguuggagaucuucguguggggagaca

SEQ ID NO: 2250297 - RNA, 130 nt, Homo sapiens
aacuccugaccucagguuauccacccgucuuggccucccaaagugcugggaugggccaggcgccguggcucacgccuguaaucccagcacuuugggaggccaaggcaggcagaucacgaggucaggaguu

SEQ ID NO: 2250298 - RNA, 83 nt, Homo sapiens
gaugugcuagcagugucuagguaggccaucauucguuuaguaaaacucuauauggauuugcuuauacacaugugcagaauauc

SEQ ID NO: 2250299 - RNA, 60 nt, Homo sapiens
ggagcugguaugaaaaucuccccaaagccagggcauugguggauugauauuaccauuucu

SEQ ID NO: 2250300 - RNA, 61 nt, Homo sapiens
aaguucagauuugacugguuucucaugagccacaugugggaauguagcaaaucugcaauuu

SEQ ID NO: 2250301 - RNA, 94 nt, Homo sapiens
uuaugucucuacuuauugucagugcauguaaacauaaaaauauuguaauuuuauauuuuuauguuuuugcuugguuuuuaagugggguauauaa

SEQ ID NO: 2250302 - RNA, 72 nt, Homo sapiens
ugaagggcaaacacugugugauuauuucaauugaugcugagaaagcauuugaaauaauucaacaucccuuca

SEQ ID NO: 2250303 - RNA, 60 nt, Homo sapiens
ugcugcuguuguuguuacuagcaaagccagcuggggauguuagagaccaaccacagagca

SEQ ID NO: 2250304 - RNA, 67 nt, Homo sapiens
gauaaaucuuaucuuuguuacuuguuuauggcuggaagcggaaauaagucacacagauuaauuuauu

SEQ ID NO: 2250305 - RNA, 56 nt, Homo sapiens
uaucuccuucuuccaagguuaugaucuuagaaacauagcugaugauguaggggaug

SEQ ID NO: 2250306 - RNA, 88 nt, Homo sapiens
gccgguugggugugcguuggugcuucagcggcgccguggaggguccgggucgccgggggaugggcaccagcgccgaagccaggcuggc

SEQ ID NO: 2250307 - RNA, 55 nt, Homo sapiens
uugagauggagucucgcugugucacccaggcuggagugcaguggcaccaucucag

SEQ ID NO: 2250308 - RNA, 55 nt, Homo sapiens
aaagugcugagucuaggcggggcgcgguggcucacgccuguaaucccagcacuuu

SEQ ID NO: 2250309 - RNA, 84 nt, Homo sapiens
gagaaucauuugaaaucugaagguggagguugcagugagcuaucgcgccacugcacuccagccuugagagcaagacuguaucuc

SEQ ID NO: 2250310 - RNA, 79 nt, Homo sapiens
ugaucagucaccacaaaugugguugcaaauauauuagguuccaaugauagaaaugcaaagaaauuuuggugaccaguua

SEQ ID NO: 2250311 - RNA, 72 nt, Homo sapiens
ugagggcggguguuuuacccuugcagagacauuuucuugaauucuggagggcccacauccacaaugcccuca

SEQ ID NO: 2250312 - RNA, 83 nt, Homo sapiens
agaauuuuaugucaguguuuggaaucucaauuucuuaguaaaaacacuauuagaaauuagagacagauagugaaauauuuuuu

SEQ ID NO: 2250313 - RNA, 68 nt, Homo sapiens
gagacaggaggauuccuugagcccaggaguucgagaccagccugugcaaacaagugaaccccugucuc

SEQ ID NO: 2250314 - RNA, 60 nt, Homo sapiens
uguuaauugaaugcagaugccagggaggagcaacuuccagggcaugugcaucaagagaca

SEQ ID NO: 2250315 - RNA, 82 nt, Homo sapiens
cugcguucaguacuuaaugugaugauucugaguugacuugagguaaucaggcauuagcacaguucauucauguuaaaugcag

SEQ ID NO: 2250316 - RNA, 72 nt, Homo sapiens
uuugcauuauuuuauuuauuuauaguuuuaacuuuuaaauggaaguggaacacauaaauagcauaguguaga

SEQ ID NO: 2250317 - RNA, 61 nt, Homo sapiens
uuucucagcgcccuccugaagaggggccuucugggucuucuugaggcaugccgcugggaga

SEQ ID NO: 2250318 - RNA, 58 nt, Homo sapiens
uucauuucuugauucccuaucugaggucucuccaguucuuagagguuuaagaaaagaa

SEQ ID NO: 2250319 - RNA, 68 nt, Homo sapiens
ggucaccagguggcugaggccaugacacucccagaggagacgugaugaggacccaucaccuggugacu

SEQ ID NO: 2250320 - RNA, 101 nt, Homo sapiens
uacauguuccaccuuacaagugguucaugaacacccucaauagugucuguuguuguucccuuguguucaugaguucucauuuuuagcucugagaacaugug

SEQ ID NO: 2250321 - RNA, 66 nt, Homo sapiens
gggguaugacugaggccaucacccagguaauaagcauaguaccuaguaggugguuuuucagaccuu

SEQ ID NO: 2250322 - RNA, 111 nt, Homo sapiens
gaauucuacaaaaagaguauuucaaaauugcucugugaaaaguaaacuucaacucuguggguugaaaguaaacaucacaaagaaguuucugugaaugcuucugucuaguuu

SEQ ID NO: 2250323 - RNA, 68 nt, Homo sapiens
gggccagguaucgucuuuaguagcuuauggaaaaugugccagaccaauggcugagggaugccugguuc

SEQ ID NO: 2250324 - RNA, 66 nt, Homo sapiens
uccugcauucugacuugcuuucacugagaacaauggagaggcuggaguuauagucagaauucagga

SEQ ID NO: 2250325 - RNA, 73 nt, Homo sapiens
ccugagaacugagauaagugauauucuuuucuauuuuguaaauucaaguaguauugauuucuuagauuucggg

SEQ ID NO: 2250326 - RNA, 97 nt, Homo sapiens
gagcuggauggaugauguguuuuaggaucucagcauaguaugggccaaauaccugcugauuaugaugcaucagauugagaaacuuccagcccaguuc

SEQ ID NO: 2250327 - RNA, 64 nt, Homo sapiens
ugcccaaggccauaugauauaaguucucuuaccuucuacacuugugucaugguugacuuuggca

SEQ ID NO: 2250328 - RNA, 55 nt, Homo sapiens
ccagaccuuacuggugcagguagacgccagcucuuuuuguaucucuggguacugg

SEQ ID NO: 2250329 - RNA, 113 nt, Homo sapiens
caauauugcaggggauguacacacccucugugauguuguuccuaguauccaaaaguagagacgaugauauuacuggcuauaucgcaagggguguacacccuucugugauauug

SEQ ID NO: 2250330 - RNA, 61 nt, Homo sapiens
ugagaccuuucauuucucagugcggccagucacaugcugcugguugagaacugaggucuua

SEQ ID NO: 2250331 - RNA, 65 nt, Homo sapiens
uucucaaccauucucagucccauccucaagagcugaugcaccuuauguaacugggaaugugagag

SEQ ID NO: 2250332 - RNA, 67 nt, Homo sapiens
ugggcaaacuauagaauugucaaguugacaacuaaguuguuuucaacuaauuuuuuggugaggccua

SEQ ID NO: 2250333 - RNA, 78 nt, Homo sapiens
ucuuugucacuggaggagaggaaguggagacugaaugacuuuacucaugaauucacauuuuuguccaguuugcaaaga

SEQ ID NO: 2250334 - RNA, 60 nt, Homo sapiens
agucuuuucccauuguucugcucuguggaagucaccuucagaguaauagugggggugacu

SEQ ID NO: 2250335 - RNA, 66 nt, Homo sapiens
ggguggcauuugcugaagagcgguaugacaugaaaaucaaauccuugagaaaauaaaugaccacuc

SEQ ID NO: 2250336 - RNA, 70 nt, Homo sapiens
uuuagcauuuccacagggauuugcauugaucaagugugacagugagacccaguucccuuggacauuuaaa

SEQ ID NO: 2250337 - RNA, 123 nt, Homo sapiens
ggaguucauuguagauucugaauauuugcccuuugucagaugaguagguugugaaaauuuucucccauuuuguaaguugccuguucacucugaugguaguuucuuuugcugugcagaagcucu

SEQ ID NO: 2250338 - RNA, 99 nt, Homo sapiens
uuaugauauuaugcuugugacuggauguacagucaguauuuguguguaaauuuaaauauauaaauuucauguguaugugcaguuaauauucauucauga

SEQ ID NO: 2250339 - RNA, 80 nt, Homo sapiens
ugguacauguguggguaagucuaaacaaauguuguauuaacauuaauaacaaugucuuaugggcuuaaaaacacaggcca

SEQ ID NO: 2250340 - RNA, 77 nt, Homo sapiens
ugcucgggucuuuuuaaagcacaaguaaagaauacuuaaaacuaaauauugacuguacuugucuucaucccgcagua

SEQ ID NO: 2250341 - RNA, 61 nt, Homo sapiens
caucccuuucugauacuuucccugaaucccagucuggaaaggguaguaaaagaggcgggug

SEQ ID NO: 2250342 - RNA, 80 nt, Homo sapiens
guuggaaggcacaguuaaagggucaugugaccaaggagggaaaugccuuugucacaugacuuuuugguggccugauuagc

SEQ ID NO: 2250343 - RNA, 77 nt, Homo sapiens
acgaacguggauaucuguugauaagucuguccccaggcccauauagcuacagaucagagauauuuagguuacaacgu

SEQ ID NO: 2250344 - RNA, 63 nt, Homo sapiens
agugugaacagaaccugggaucgaagucacuccugugauuaggugacuaauucuguucacauu

SEQ ID NO: 2250345 - RNA, 81 nt, Homo sapiens
agaggaaugagguguuuauuguauccugaaggagcucacagggaggaagcaugcaggaaaauaaauaccgacaaagucucu

SEQ ID NO: 2250346 - RNA, 85 nt, Homo sapiens
uagcuaugugacauuggaagauuacuuaguuuucucuuuuguaagaugaaaauaguaauaucuaccuuagaguguuauagaguua

SEQ ID NO: 2250347 - RNA, 61 nt, Homo sapiens
agucaucauugguugugguguuucuugggguagagguauaugcuacuggacaauggugacu

SEQ ID NO: 2250348 - RNA, 60 nt, Homo sapiens
augccucccaaaaguguucauauuuuaauucucagaacaugugaacauguuggguggcau

SEQ ID NO: 2250349 - RNA, 61 nt, Homo sapiens
uagguuaccaccuaaccccuaauugugugucuuaccacauaaugcaaguggugguaaucug

SEQ ID NO: 2250350 - RNA, 67 nt, Homo sapiens
aauagauacauuggauaauggugggcauacaauaguccuaugcccaccauuaaaacaaguauauauu

SEQ ID NO: 2250351 - RNA, 67 nt, Homo sapiens
aacagucauggguugccauggugauuauuccaaaugcauugugaucauauggaacuggugacguguu

SEQ ID NO: 2250352 - RNA, 102 nt, Homo sapiens
uuauacuuuaaguuuuaggguacaugugcacaacgugcagguuaguuacauauguauacuugugccauguuggugugcugcacccauuaacuugucguuuaa

SEQ ID NO: 2250353 - RNA, 55 nt, Homo sapiens
uugagauggagucuugcucuguagcccaggcuggagugcaguggcaccaucucgg

SEQ ID NO: 2250354 - RNA, 68 nt, Homo sapiens
ugcaggcaugacauuucacucuuagauaugccaggauauaccuucuaagaaugugaacauucucugca

SEQ ID NO: 2250355 - RNA, 69 nt, Homo sapiens
acagaauuaagccucugacaacuacaagaacuuagaaaggacuuugaugucaagaugguuugauguugu

SEQ ID NO: 2250356 - RNA, 56 nt, Homo sapiens
cugugaacaugggagaaauggcucucagucugugcacaauuuucccuggaacauag

SEQ ID NO: 2250357 - RNA, 59 nt, Homo sapiens
cuggcucauuucauuuagcauaauggccuaaguuucaucuguguuggaguaugugucag

SEQ ID NO: 2250358 - RNA, 65 nt, Homo sapiens
gauuacaggcgugagccacugcgcccggccacagccauuuauuuugcaguguucugaccugaauc

SEQ ID NO: 2250359 - RNA, 83 nt, Homo sapiens
cagaacuguguuuucauugguuaaucaccgguguccagugaucuguccuucauagccugugaaaauuuauaacauccuuucug

SEQ ID NO: 2250360 - RNA, 61 nt, Homo sapiens
agguaacuugggucaugaggguuuguuguauagauuaucucaccacucgaguauuaagccu

SEQ ID NO: 2250361 - RNA, 73 nt, Homo sapiens
cuguuaaaaucaaggagcuggacgggcacgauggcucaugcccguaauuccagcacuuugggagaccgagcag

SEQ ID NO: 2250362 - RNA, 59 nt, Homo sapiens
ucccaucgucuccuggaugauaugcaauguccugcagucacagggagauggugacagga

SEQ ID NO: 2250363 - RNA, 80 nt, Homo sapiens
aggagaaugauaugauugugauguuugaguggcaccagaccuuugguuuacuguagugucauaucguaucucagucuucu

SEQ ID NO: 2250364 - RNA, 85 nt, Homo sapiens
caguggaaaagaaacauauuacauagaaccccuucgaacacauuauuaaguaguuggaaugguuggugugauuuuaaaguuacug

SEQ ID NO: 2250365 - RNA, 77 nt, Homo sapiens
aggguucaauaaauaguaguugugguggccauucuuacuagguuugguugcaggcaagugcuauucugcuggucccu

SEQ ID NO: 2250366 - RNA, 55 nt, Homo sapiens
cugagaucaagucuugcucuguugcccaggcuagagugcaguggcuugagcucag

SEQ ID NO: 2250367 - RNA, 79 nt, Homo sapiens
gacaauucuuggcagaguuaauuuguugagugccuuuaaaaguaaaaucauauuagcagauugcuuuucagaaguuguc

SEQ ID NO: 2250368 - RNA, 65 nt, Homo sapiens
auggucccauucauucacguauuugucuacuaauugacagcuauugaguaccuaaugggaaccgu

SEQ ID NO: 2250369 - RNA, 83 nt, Homo sapiens
aggaaggagcucccaacucucaacugccaguaggguuauuucucauauugcauuugagguugguugacuuaugguucuuucuu

SEQ ID NO: 2250370 - RNA, 93 nt, Homo sapiens
ggauggggaaaagagcugagaguuuaugcugaaauggauuuauagaauauuuguaaaucuauuuuuaguguuuguucguuuuuuuaacuguuc

SEQ ID NO: 2250371 - RNA, 58 nt, Homo sapiens
cauggcaaaaccccguuucuaguaaaaauacaaaauauuagccggguguugugucaug

SEQ ID NO: 2250372 - RNA, 83 nt, Homo sapiens
uucucuggccauagcuggcuagaauagggauagaccuugaccuaagucaagccuaucaaauucugccuccuaugaguuuagaa

SEQ ID NO: 2250373 - RNA, 108 nt, Homo sapiens
uucuguaaauggugauuggguucccagaccuaucuauaaaagugaauccagcccacaguguauucacuuuuauagacaggucugggaacccgaucaccacguauagaa

SEQ ID NO: 2250374 - RNA, 81 nt, Homo sapiens
gacuauuagauuagugagguagagcaugugaaagauuguaagagcacaaugccuucacauauuauuucaucaauaaagguc

SEQ ID NO: 2250375 - RNA, 58 nt, Homo sapiens
gugaauagugcugcaaugaacauaugagcgcaugugucuuuauaacagcacaauuuau

SEQ ID NO: 2250376 - RNA, 60 nt, Homo sapiens
gagaaugaugauuuccaauuucauccaugucccugcaaaggacaugagcucaucauuuuu

SEQ ID NO: 2250377 - RNA, 94 nt, Homo sapiens
gcuuccuggucauggcaguguaugauuauauuaugauaucccgaucaugguagauuucugaugauacuaguugccaaaacaugauggaggaagc

SEQ ID NO: 2250378 - RNA, 68 nt, Homo sapiens
ucagucauggguuaaagguggauacuuauuauggauugaacugugucucccccaaauucauguauuga

SEQ ID NO: 2250379 - RNA, 76 nt, Homo sapiens
ucauuuuuacuuguaucugcacugaaaggauacauaagaaacuaaagugauuccauguagaagacaggggagauga

SEQ ID NO: 2250380 - RNA, 69 nt, Homo sapiens
ugagauacugaaaauagcuaacaaaccuacuuuauuacuuucaaagguccuagcuagauuggguacuua

SEQ ID NO: 2250381 - RNA, 86 nt, Homo sapiens
ucuuuuaaggaugcauacugaaauauuuuagagauaaaaugauauuagggauuugcuuuaaaauaacacaguauggauggagggga

SEQ ID NO: 2250382 - RNA, 63 nt, Homo sapiens
auugaaucagguaguuucagucauaguacgcuuacuucaggaaaugacuauagccugaucagu

SEQ ID NO: 2250383 - RNA, 81 nt, Homo sapiens
acacuauacuuccauugcugguggccuugagaauagaaacauuuggcucagcaagaaucugggaguaaaauucuuuggugu

SEQ ID NO: 2250384 - RNA, 71 nt, Homo sapiens
cauugauuuugcauccugagacuuugcugaaguugcuuaucagcuuaaggagauuuuaggcugagacgaug

SEQ ID NO: 2250385 - RNA, 70 nt, Homo sapiens
gggaaugggcaugagggagaucuccagggugaggucaacguccugucuuggauccaucacgccucuuccc

SEQ ID NO: 2250386 - RNA, 55 nt, Homo sapiens
guaggacugaauuccuucccauggauguagggccauggaggucaucugucacuac

SEQ ID NO: 2250387 - RNA, 68 nt, Homo sapiens
acaaugaaggaaaagggccuagaauuuuauuuugaguacaguaaugggccccuuuuccuauugguugu

SEQ ID NO: 2250388 - RNA, 68 nt, Homo sapiens
cuuguaaagcuguagauugcuaauuacuggaucaaaauuuuacauguggcaguuuacagcuuuaggag

SEQ ID NO: 2250389 - RNA, 72 nt, Homo sapiens
guccaaaugagcuuguaugacuguuugcucauucaggucuugcagcagccuugagugguagacauuauggac

SEQ ID NO: 2250390 - RNA, 78 nt, Homo sapiens
guuacauaugcaagacaccgauuagcuuuuucucugaaugagauggagagccauuggaguuuugagcagaaaagugac

SEQ ID NO: 2250391 - RNA, 78 nt, Homo sapiens
gggaggugaugagaucauaaguguggagccucaugaaugggaugagugcccuuauaaaaguggucucagaaagcuccc

SEQ ID NO: 2250392 - RNA, 78 nt, Homo sapiens
gugucuuuauuagcagcaugaaaauggacugauacaguaaauugguaccaguagagugggguguugcugaaaagacac

SEQ ID NO: 2250393 - RNA, 65 nt, Homo sapiens
gcuuuuugcugcagcaauacuggagauggcaaaacauugagacucagaggcugucagcaagaagc

SEQ ID NO: 2250394 - RNA, 128 nt, Homo sapiens
ugaugauuagugauguugagcauuuuuucauauacccugcauuagucuguuuaguguugcuauaacagaacaccugagauuggguaguuuauacaaaaaacgugucuauuuaacucaugguucuauca

SEQ ID NO: 2250395 - RNA, 58 nt, Homo sapiens
ugagacggagucucgcugugucacccaggcuggggggcaauggugcgaucuccgcuca

SEQ ID NO: 2250396 - RNA, 93 nt, Homo sapiens
ucuuuuuaucuaacagucuacucacugcauuucaguuuuguucugauuacauuugaaguucuaacaaacaauguaaugaauggaguaagaaga

SEQ ID NO: 2250397 - RNA, 77 nt, Homo sapiens
gggaacuuuucagaacauaaugugagcauauuugggaaaggcaaugugcaauucacuguuaugucugugcuuuuccu

SEQ ID NO: 2250398 - RNA, 63 nt, Homo sapiens
aggaaguuagcaugacuuuccuugguuuaaaagacagacucaggaagguaaacuaacuugccu

SEQ ID NO: 2250399 - RNA, 83 nt, Homo sapiens
gcuucuuucacugagaaugauguuucugagguucguccacacugaggcauguaucagaacuucauucuuuuugaugacugagc

SEQ ID NO: 2250400 - RNA, 89 nt, Homo sapiens
cuuuugguggcuuggcauuguguugauagaaguuauuuuucaaggauuccuaagcuuuuucuaaucauaauugucuccgccaugaaaag

SEQ ID NO: 2250401 - RNA, 83 nt, Homo sapiens
ggagaaucgcuugaaccugggagguugcagugagccaauaucuggccauugcacucuagccuaggugacaacagcaagacucc

SEQ ID NO: 2250402 - RNA, 62 nt, Homo sapiens
gauaagguuuggaguacaacugaucccgucacccaggugugcauaguacccaauacuuuauc

SEQ ID NO: 2250403 - RNA, 78 nt, Homo sapiens
cagaggcaaguggccaccgagucugugauugggauccuccuguggagaccuguggagacucguggcucacuaccuuug

SEQ ID NO: 2250404 - RNA, 94 nt, Homo sapiens
gauuacauagaaauguuaaaguuuacagugcacauggguugggccaaagaaagugcuugacacaugugcguagacucuuuauugacugcggauc

SEQ ID NO: 2250405 - RNA, 80 nt, Homo sapiens
gacagagugaauauuauauaaggcugaauaauauucuauuguauauauacaucaugucuuguuguauuuauuuaccuguc

SEQ ID NO: 2250406 - RNA, 97 nt, Homo sapiens
cagcuguuguauagugcacauaaggaaaguauucuuauuaacauaauuauauuuagugcuagaugacuuugccauguguagauuaccauccuagcug

SEQ ID NO: 2250407 - RNA, 66 nt, Homo sapiens
cugcuccauggcuuuuccugucuugcaugugaccuucacaguauggcgaugaagggugaugagcag

SEQ ID NO: 2250408 - RNA, 72 nt, Homo sapiens
auagagaugauaggcuaggccaaggacuuuuuaccucccuaacaucucuuggauccauccugucuucucuau

SEQ ID NO: 2250409 - RNA, 57 nt, Homo sapiens
uaguccauaggaauuuuucagccccuauaauagggcugaauagucaacgauggacug

SEQ ID NO: 2250410 - RNA, 86 nt, Homo sapiens
acucauugcuucaaucaauguaaugguaauauaaauauccaguagauuuugauucauauauggcccuuaaguauugguugaugagu

SEQ ID NO: 2250411 - RNA, 65 nt, Homo sapiens
agcacuucuucagccaacuucuaagaaugcacaaguagcuuccauggaauuaauggagagguguu

SEQ ID NO: 2250412 - RNA, 95 nt, Homo sapiens
cuaaucaaucagcaggagcagccuagagagccacuuugagaagaauucugaggcugucucugggcuccacuugaaaucuuaucuugauugauuag

SEQ ID NO: 2250413 - RNA, 128 nt, Homo sapiens
agcaaggguaacuguaaugucuguauuaagggaagauugugauggucaaaggaaauagggcguauguaacugcuuuauuuucuacaagcaucauaaacugaucuauacacauuuauguaguucuuguu

SEQ ID NO: 2250414 - RNA, 72 nt, Homo sapiens
cacuauugcccaggcuggagugcaguggugugaucucggcucacuguaaucucagccuacuggguucaagug

SEQ ID NO: 2250415 - RNA, 91 nt, Homo sapiens
cacaaaaaaguucagagauuuuaagccuuugaagcaaggcugauacguuaaaaauucaagugguucagaagucugaacuuugaagcuugug

SEQ ID NO: 2250416 - RNA, 58 nt, Homo sapiens
ugagccaugaucgugucacuccacuccagccuaggcaacaaagugagaucauggcuua

SEQ ID NO: 2250417 - RNA, 64 nt, Homo sapiens
ccagaggaggaaggaauguuaaugaauguuuccauugguuaucacuuuccuuccaucugccugg

SEQ ID NO: 2250418 - RNA, 57 nt, Homo sapiens
cuagggguugaggucuccauuuuggcacuugcuaacacuaugagagccgauuccugg

SEQ ID NO: 2250419 - RNA, 70 nt, Homo sapiens
gucccuggucuucugggcuugucucuuccaggguagaccuccuacucuguaagcaagcuggggaaggggc

SEQ ID NO: 2250420 - RNA, 76 nt, Homo sapiens
guaaauagccauauauagcuagucacugcuggauugcacugcacagguccaaaggauuggauguucaggcguuuau

SEQ ID NO: 2250421 - RNA, 63 nt, Homo sapiens
ccuaaugacauugaugcucuggcugggagggcucagucccggagggggugucaaguugauagg

SEQ ID NO: 2250422 - RNA, 64 nt, Homo sapiens
aagcaagguacagaaacagccggaaugguuacagcucagcguuuggcuuauuugaaucuggcuu

SEQ ID NO: 2250423 - RNA, 56 nt, Homo sapiens
guucuuucuguugugucuucaggguguugauuugagugugacuuagcagaaggagc

SEQ ID NO: 2250424 - RNA, 59 nt, Homo sapiens
uggcaacuugcaaccucauucucauggaagagauaauaggggaugauguaacuaugcca

SEQ ID NO: 2250425 - RNA, 82 nt, Homo sapiens
gaauaacuaggcaaaugcaagaguagaacucaauuugaacuuaaaucaucuugguuuuagguuuuuguuugcucauuuguuu

SEQ ID NO: 2250426 - RNA, 91 nt, Homo sapiens
gcccagcgaugaacauacaagugcauaugucuuuuuggaagaaugauuuauuuucuuuuggauauauuacucaguaaugggauugcugggu

SEQ ID NO: 2250427 - RNA, 64 nt, Homo sapiens
aguuaguuauagaguuuaauugguuauaaucuuauuugaauuaguuggcugccuaugauuaacu

SEQ ID NO: 2250428 - RNA, 77 nt, Homo sapiens
cugaauucauguggaagggaggacuaugugucuuucaagaccuuuuccacuuuugguccucugcuuccagaauucag

SEQ ID NO: 2250429 - RNA, 91 nt, Homo sapiens
uauccuaugccuguaccaccauuguaguuuggaaaaagauaacuuguuuugauuucacaggcucacagcuggaggaauuugccuugggaug

SEQ ID NO: 2250430 - RNA, 98 nt, Homo sapiens
gugggguauuuuauguaauucauagucacuuccaauguauaguuaaguuacugcuagcugcacugguauaggagaaauguucguaaaacgcucaccac

SEQ ID NO: 2250431 - RNA, 59 nt, Homo sapiens
ugccuccaaguggaaauauuugucaucugccuugguagagcuugacacuuuccauggca

SEQ ID NO: 2250432 - RNA, 60 nt, Homo sapiens
gaagacuuuucccugggacaguuguggucugugguuacaaguaauaagggaagaauuuuc

SEQ ID NO: 2250433 - RNA, 129 nt, Homo sapiens
gauauuucauuaauaucauaguguguaaacacugugucuaaacacuggauaugauaaauauuagagcaagaugucauuaauaucccaguguguaaacacugugucuaaacacugaauauuauaaauauc

SEQ ID NO: 2250434 - RNA, 84 nt, Homo sapiens
cagauaucuuuauagcaaugccccacuccuugguuccaauuuucuguauuaggcuguucuuguguuguuauaaagaaauaucug

SEQ ID NO: 2250435 - RNA, 79 nt, Homo sapiens
uuuucccccagaugaggacaucuuccuuauggaugaagcaauucgugaauaagagaaaaugaucccaaggaggggaaaa

SEQ ID NO: 2250436 - RNA, 99 nt, Homo sapiens
agacgcuuaggcccagucacucuuuuaaugcuuucuuugcuuacuuaguuuaaaggugggagcauugcauuagaagcccagagauccggcuuuuagucu

SEQ ID NO: 2250437 - RNA, 58 nt, Homo sapiens
ugagacggagucucacucuguugcccaggcuggagugcaauggcgugaucuccgcuca

SEQ ID NO: 2250438 - RNA, 57 nt, Homo sapiens
uguguccauguguucucauguucaacucccacuuaugagugagaacauguguacaca

SEQ ID NO: 2250439 - RNA, 87 nt, Homo sapiens
aaauguuuauaguauucugugaugguaguuuguauuucuguggggucagcggugauaccccuuuaucauuuuuuauugugucuauuu

SEQ ID NO: 2250440 - RNA, 65 nt, Homo sapiens
gugagaaagaggguguuucaacuuagacauguucucugucaauguaggaaaugccucuugcuuac

SEQ ID NO: 2250441 - RNA, 64 nt, Homo sapiens
gccucagucucuuucugccuuaugacucuuaaauucuuucuuaucaagaggcaagaauugaggu

SEQ ID NO: 2250442 - RNA, 79 nt, Homo sapiens
uaagagaguuaaagaauaagaaacaaagucuguauauuuacccauacaguugccauuucuugugcuugucauuuucuua

SEQ ID NO: 2250443 - RNA, 74 nt, Homo sapiens
gggaaaggagguauauuggacagauguaaauaguauuuauuauuuuauucuucucaauaauaucuccauuuccc

SEQ ID NO: 2250444 - RNA, 88 nt, Homo sapiens
cuucaucuaccagugaguacaugcacugagagggucucggcuccccuggaggccucccuccaccacugcaggucacuuacucaugagg

SEQ ID NO: 2250445 - RNA, 86 nt, Homo sapiens
cuauuagguuggugcaaaagugauuguaguuuuugccauugaaaguaauggcaaugaccgcaauuacuuuugcaccaaacuaauag

SEQ ID NO: 2250446 - RNA, 58 nt, Homo sapiens
guauauauuauacauuauauagcauguagugauguaugauguaauguaugauauguac

SEQ ID NO: 2250447 - RNA, 61 nt, Homo sapiens
gcuuucaagcuacaguggcaggguugugucauugcaacagcaacuguauggcuugcaaagc

SEQ ID NO: 2250448 - RNA, 93 nt, Homo sapiens
ccuuuuugguuuuagaagagaaugacuuauuuucauauauauucauauaugugguuaauaggaauuugugaacuaaaacuuaaaacaaaaagg

SEQ ID NO: 2250449 - RNA, 70 nt, Homo sapiens
ucauuccacaggcagucucugccggcugaggguggugacaaccucuguuugcuggagaugccuggagugg

SEQ ID NO: 2250450 - RNA, 61 nt, Homo sapiens
uuucccuuacuuaaacuuacucucauuauuuguggagaguaaguuuagaugaaaggaggaa

SEQ ID NO: 2250451 - RNA, 70 nt, Homo sapiens
ucaucucaguuucuugccguaccuccuccccuagauauaacugcagguacuuacggccagaagcagguga

SEQ ID NO: 2250452 - RNA, 86 nt, Homo sapiens
gagucuugcucuguugccuaggcuggaaugcaguggcgcaaucuuggcucacugcaaccuccgccucauggguucaagcaauucuc

SEQ ID NO: 2250453 - RNA, 59 nt, Homo sapiens
gugguggggcccucuagauccaggggcugguuaagcugaaucagguagggccccauuau

SEQ ID NO: 2250454 - RNA, 61 nt, Homo sapiens
uuuuuuaaugggucucaaaauucugugacaaauuuuuggucaaguuguucccauuaaaaag

SEQ ID NO: 2250455 - RNA, 84 nt, Homo sapiens
ccagauuuagugugcaaagaagaaacucuugacuucaauguugugaggucauggauugucuuuucuugucauugacuuuuuugg

SEQ ID NO: 2250456 - RNA, 64 nt, Homo sapiens
uugagaaccucugugugcccacuggucaauuuccucuuccuucaguuuacagggagguuuuuaa

SEQ ID NO: 2250457 - RNA, 115 nt, Homo sapiens
gcuugcuuuguuaaaugugugaaaugagaaaguggacuaagugaauaugaauagaauuggauauauuuauacauuugcuuuauuugaaaguuuaacuaugcuuaauauugcaggu

SEQ ID NO: 2250458 - RNA, 63 nt, Homo sapiens
uguacagugucucucaguuugggaucaucugauguuauuuaaugauuagagagaggcugugca

SEQ ID NO: 2250459 - RNA, 60 nt, Homo sapiens
aaggaauggggaacggaugcuuacugagagcuacucugugccaaguacugucccauccuu

SEQ ID NO: 2250460 - RNA, 58 nt, Homo sapiens
aauggcaguagauggauggguaggucucuggacacacaauaaaguccguccugucauu

SEQ ID NO: 2250461 - RNA, 65 nt, Homo sapiens
ucccuaucgacacugaccuaguucagcaccugaccccaucugcaccuaggucagguguccuggga

SEQ ID NO: 2250462 - RNA, 63 nt, Homo sapiens
gccuuuuuuauguugagauauauucuuuccauacuuuguugaguguuuuuaacaagaaagggu

SEQ ID NO: 2250463 - RNA, 58 nt, Homo sapiens
cuuuccuaguccugagucucugcgucccacuggugacgcuggggcggggcuaggagag

SEQ ID NO: 2250464 - RNA, 57 nt, Homo sapiens
uauagcaugacacuuguugaaugcuggagaaggccagcgcggugacucaugccugua

SEQ ID NO: 2250465 - RNA, 60 nt, Homo sapiens
gauauugauguuaauauuauauguuuacacuuacguagauauguuauugauguuaauguu

SEQ ID NO: 2250466 - RNA, 99 nt, Homo sapiens
ggggaugguggggaccgagauggaggaggaagcugaaacaagagggcccuuguucucauuuccauccucuguguaccugccucugccccaccagccccc

SEQ ID NO: 2250467 - RNA, 88 nt, Homo sapiens
ucaucgaggauccaugguauggcaguuucagcuauaguuuuugcucagggauuuauuguuggaauucuauccuggaucuauguuguga

SEQ ID NO: 2250468 - RNA, 76 nt, Homo sapiens
auuuaggggcacacuucgguuagcauuguucugaaugaauguaugacucaaugcaggucaagauguacccuuagau

SEQ ID NO: 2250469 - RNA, 70 nt, Homo sapiens
aacgugguauuuggaucccuguuucugcauuaauuugauaagaauaacagucuccaguuguauccauguu

SEQ ID NO: 2250470 - RNA, 58 nt, Homo sapiens
auacugcuguaaacaauuuaaauagguuuucaauuauuuuggauuguuagagcagugu

SEQ ID NO: 2250471 - RNA, 64 nt, Homo sapiens
auugugaauagugcugcaauaaacacacgugugcaugugucuuucuagcagcaugauuuauaau

SEQ ID NO: 2250472 - RNA, 68 nt, Homo sapiens
ugauaucuuuuguauggugagcugcacauuuaauaaagaagcagcugccacuacugaacgauuaauca

SEQ ID NO: 2250473 - RNA, 74 nt, Homo sapiens
agggaacacuuucacacuguuggugggaauguaaacuaguacaaccacuguggaaaacagugugaagauuccuu

SEQ ID NO: 2250474 - RNA, 82 nt, Homo sapiens
accugcaaauaaauaauugcaacacagggcuuuggggguccuuauccuaaguguuuuguauugcaauucuuaagugguaggu

SEQ ID NO: 2250475 - RNA, 60 nt, Homo sapiens
ggaaugauuaagucauuucauggagugaggauuuuuauuucauggggauuuacucauucc

SEQ ID NO: 2250476 - RNA, 68 nt, Homo sapiens
auugcuuaaaccugggacguggagguugcagugagccgagauugcaccacuacacuccaggcuguaau

SEQ ID NO: 2250477 - RNA, 75 nt, Homo sapiens
ggagguggaccuugcacugagccgagauugagccacugcacucaagccugggugacagugcaagacuccaucuuu

SEQ ID NO: 2250478 - RNA, 59 nt, Homo sapiens
cugagcuuguuuuccugcaacuagauggucccaucugggggugauggagacagugacag

SEQ ID NO: 2250479 - RNA, 57 nt, Homo sapiens
uaugagagcugguagguagagagucaaauggcuauugcugccuaccugguugucaua

SEQ ID NO: 2250480 - RNA, 55 nt, Homo sapiens
agcucguaugaucucauuuauguucauuucucauugugauggugcauacugagcu

SEQ ID NO: 2250481 - RNA, 77 nt, Homo sapiens
ggaagaaaggcaaagcaaugcugguauuguuguaauaugauguuuaugguagaagcaacauuuuugaccuuucuucc

SEQ ID NO: 2250482 - RNA, 85 nt, Homo sapiens
ugacuacuuaagugaauuucacuacugagugacaaagaggaaaaaaggccauuuauagaauaugaaguuuagacuuaguagcuca

SEQ ID NO: 2250483 - RNA, 78 nt, Homo sapiens
uuugaacccaggagcuugaggcugccgugugcugugaucgugccugucauagcacugcacuucagccugggaaacaaa

SEQ ID NO: 2250484 - RNA, 74 nt, Homo sapiens
ucagauuuacuuaagcccaguuauauaauuuccauacagaaggacuuauggccacugucuuugagucacucuga

SEQ ID NO: 2250485 - RNA, 60 nt, Homo sapiens
ugaaagcucuguuuucagcaccuccagguuugccagugagguguuguugaggagauuuca

SEQ ID NO: 2250486 - RNA, 82 nt, Homo sapiens
agcucuaguaguaaugguuaaaggcauguacacuagagucagccacacuugagucugauguuugucucuaacaacuagaguu

SEQ ID NO: 2250487 - RNA, 76 nt, Homo sapiens
cuuacagucuaucagccacaacuugaaguaucuucucuccucuuugcugccaaauaaugucucugaagacuguaag

SEQ ID NO: 2250488 - RNA, 73 nt, Homo sapiens
ggcaaggcacauagcagggaaacccauucuugauaacaacgcagugaaucuguuuucuucuguucuuauugcc

SEQ ID NO: 2250489 - RNA, 100 nt, Homo sapiens
agaauauauguauacacauauauacccauacauauuggugacugucugaaggauggagaggcugccauguauggguauauauguguauauaugugugucu

SEQ ID NO: 2250490 - RNA, 60 nt, Homo sapiens
ucauaguuguauacauuuacgggguauaauguaauguuuugauauguguauagcaugugg

SEQ ID NO: 2250491 - RNA, 84 nt, Homo sapiens
ucagguaucuuuauagcaaugccccacuccugauaccaauuuucuguguuaggcauucuggcacugcuauaaggaaauaccuga

SEQ ID NO: 2250492 - RNA, 56 nt, Homo sapiens
ugcagggaggagaaagaugguaugguggauacaggucauugguuggcugcccugua

SEQ ID NO: 2250493 - RNA, 58 nt, Homo sapiens
gcuugagugcaguggcacgaucucagcucacuucaaucucugccuacugggcucaagc

SEQ ID NO: 2250494 - RNA, 62 nt, Homo sapiens
uugugaguagugcugcaauaaacauaugugugcaugugucuuuauagcagcaugauuuauaa

SEQ ID NO: 2250495 - RNA, 89 nt, Homo sapiens
ggagaaucgcuugaacccaguaggcggagguuacagugagccaagauggcaccauuguacuccagccuuggggacaagagagaggcuuc

SEQ ID NO: 2250496 - RNA, 82 nt, Homo sapiens
aucaucuuugccucuuugucacaucuugggggcagccuaccugagaaugucacccacacaggagacagggagagaguaugau

SEQ ID NO: 2250497 - RNA, 79 nt, Homo sapiens
ucucaaugcuuugacaugggaagugcuugauugaugucuauuaaaaugaaucaacauuguuuuaagucaagcaaugagg

SEQ ID NO: 2250498 - RNA, 72 nt, Homo sapiens
uuuauauguaccuguuuaaaaaagugaguguacacucaaauuauuuaauuuuuggauaaugguacauguaag

SEQ ID NO: 2250499 - RNA, 75 nt, Homo sapiens
guaguaauuagcacuugggaguauuuauuuauuuauuaaauauuuauugauuaaauacugcaggcuaagcacuau

SEQ ID NO: 2250500 - RNA, 75 nt, Homo sapiens
gauguaggauaacagcauuauugcauacguuaauuauucauugaacuacuuaugucuaugaugcugacauacauc

SEQ ID NO: 2250501 - RNA, 61 nt, Homo sapiens
ugaggucauucugugguacccagcugggcugggcugggcuggaggacccaggauggcuuca

SEQ ID NO: 2250502 - RNA, 61 nt, Homo sapiens
gcuacugcacaucaucugaguuaaaaaugagaauggcuuggcuuggaaugauggcaguggc

SEQ ID NO: 2250503 - RNA, 89 nt, Homo sapiens
ggagaauugcuugaacccgggugguggagguugcagugagccuauaucguuucauugcacuccagccugggcaacaagagcgagacucc

SEQ ID NO: 2250504 - RNA, 79 nt, Homo sapiens
gagucuuggauuauaauggaauauuuggagagggaguucagacucagaucuaagaauuucuacaguaauuuaacaucuc

SEQ ID NO: 2250505 - RNA, 71 nt, Homo sapiens
uggcuaaaggaauggaacaaagucuugaaaugauaaauaaaaacaucuuauuuauuuugucuguucagcca

SEQ ID NO: 2250506 - RNA, 74 nt, Homo sapiens
uuuuaaguuaagaaguguaacuuaaguuuaacuuuuuuuuaaguguaacuuaaguguaacuuuuuaaguuaaga

SEQ ID NO: 2250507 - RNA, 89 nt, Homo sapiens
ggcuuaguguauuguaugaaaaucggagauuggguauuuuaagccaaaaauauucaacucugauuuuacauacguggauacuacuggcc

SEQ ID NO: 2250508 - RNA, 75 nt, Homo sapiens
ucuguaggaaugaugggaugucagcagaugucuagacagaaaugugcagaaucccuucagauccgaggugacgga

SEQ ID NO: 2250509 - RNA, 66 nt, Homo sapiens
uggaagcauuuuacaaaagcacagguucagacagucugacauaauugcuaagugaagaugguuuca

SEQ ID NO: 2250510 - RNA, 68 nt, Homo sapiens
cgugugugccaaaucccauaauaaauccuguuauaugagaggauuuauuaugggauuuggcucauaug

SEQ ID NO: 2250511 - RNA, 92 nt, Homo sapiens
gcaucacugguuagaggaauaauugauuaggggucaccgauggggguuauuaguuggagagucacuaguuagugcuaauagccaagagaugu

SEQ ID NO: 2250512 - RNA, 56 nt, Homo sapiens
uuggaaacgucaccuuuuccuuuagaugcuaauaugcauaaggggauguccuccaa

SEQ ID NO: 2250513 - RNA, 67 nt, Homo sapiens
uucaauuauuaacuucucccagcuuggugaugaauuucaaccacguagaugagagaguuaaagugaa

SEQ ID NO: 2250514 - RNA, 55 nt, Homo sapiens
uagagcacagugauuagaccuagggagguacaaccugcugcuuacugugcuucug

SEQ ID NO: 2250515 - RNA, 69 nt, Homo sapiens
gcuuauuuaguagagacgagcguuccaccauguuagucaggauggucucgaucugcugaccucgugagc

SEQ ID NO: 2250516 - RNA, 62 nt, Homo sapiens
auuccagaggaguccucucuuacaggcucagaggaccguguaauggcagacuccgguggagu

SEQ ID NO: 2250517 - RNA, 78 nt, Homo sapiens
guaucauugccuaaugcucucaguauggacauccuguuacacuaaaccauaaaaauccugagagcugggcagggauac

SEQ ID NO: 2250518 - RNA, 94 nt, Homo sapiens
aucagguguauauuuuacauuauagcccaucucaguuuggauuagccacaguucaaguguucaggagcuacagcuguggagagauacauuuggu

SEQ ID NO: 2250519 - RNA, 83 nt, Homo sapiens
gugguuuuugucuuugguucuguuuauaugcugaauuacauuuauugauuuguguauguugaacccaaaggaauauaaaucau

SEQ ID NO: 2250520 - RNA, 86 nt, Homo sapiens
gaggauuguuugaaccugggaggcacagguugcagugagccaagaucgcaccacugcacuccagccuaggcgacacagcaagacuc

SEQ ID NO: 2250521 - RNA, 81 nt, Homo sapiens
aucaaaugaaagguuuaauucugugagaugaaugcacacauuagaaaguaguuucacagauaaauucuuucuagguuugau

SEQ ID NO: 2250522 - RNA, 112 nt, Homo sapiens
agcuuaguugggugccucuggcucaaggucucucagauggcuacagucuuagcugugggccagugcugcagucaucugaagauuuuguuagaggauaaucagcuuucaagcu

SEQ ID NO: 2250523 - RNA, 97 nt, Homo sapiens
uuguaucuauaagaaguaauguccauuguuucaguuuuaucuuacaggugaugugaauagggaauaaugggaucagauggaucuucuauagguguga

SEQ ID NO: 2250524 - RNA, 63 nt, Homo sapiens
ucagugugguacaaagcuggagagaaaaagaacaaguguaucucugcuuaaugucccacuuga

SEQ ID NO: 2250525 - RNA, 66 nt, Homo sapiens
uucaugacuugaucacccccuaagggcccaacuccuuacguuggagauuaaguuucaacauaugaa

SEQ ID NO: 2250526 - RNA, 77 nt, Homo sapiens
uuuuccagccaaagagaaaguauuuggguuuugagcaucuuuuuaacugagaacauuccucuuccuggcuaugaaaa

SEQ ID NO: 2250527 - RNA, 61 nt, Homo sapiens
guguugcuguauucaugucuguauuuccaaugcuuggcauauaguagaugugcaguaacau

SEQ ID NO: 2250528 - RNA, 68 nt, Homo sapiens
aucauggaggauggugacaccauuggcuauggggagucuuggcagauggugacaccauuagucauggu

SEQ ID NO: 2250529 - RNA, 70 nt, Homo sapiens
gguguuucugguucuagaaccuugaggaaucaccacacugucuuccacaaugguugaacuaauuuacacu

SEQ ID NO: 2250530 - RNA, 125 nt, Homo sapiens
uggccaagauaucuaauaguuaagucugcaguguaauaguaggcauuuaccugacuuuugcuacuuuccagguagaaaguuugcugucacaugcaucuuuacugucaggaaauuaucccuagcca

SEQ ID NO: 2250531 - RNA, 72 nt, Homo sapiens
cagcucuaaacaauuaaaauaauggcauacuggaaaaaguucuugugcauguauauuaguucaccagggcug

SEQ ID NO: 2250532 - RNA, 72 nt, Homo sapiens
agaggucauuauugcuucuggacuuuuuuggaauaacaaauaccagugaauuccaggggcuaacugacuuuu

SEQ ID NO: 2250533 - RNA, 58 nt, Homo sapiens
guaaucucagcuacucgggagacaggagaaucgcuugaaccugggagguagagguugc

SEQ ID NO: 2250534 - RNA, 69 nt, Homo sapiens
gcuggcaugagguaagugcuuuauuaggaucucuuaaauuauuuccuugaaucuacuugcccauuuagc

SEQ ID NO: 2250535 - RNA, 95 nt, Homo sapiens
uguuugauucuucuuuguagcuacaaagugagaugugggccauuagguacuauggccacuauauucaaauuguauguuuaaaauagauuaaaaca

SEQ ID NO: 2250536 - RNA, 79 nt, Homo sapiens
uccacauuuauugugauugcugcuaggccuacuugauguuaagacuuggugggucuaacaggacacagcucauaguggg

SEQ ID NO: 2250537 - RNA, 111 nt, Homo sapiens
gaggugggguuuuuuuguuuguuuuugcuuuguuuugagacagagucuugcucuguugcccaggcuggagugcaauggcacgaucucgucucacugcaagcucuccgccuc

SEQ ID NO: 2250538 - RNA, 60 nt, Homo sapiens
uauggauuuuuuugacaagagcgucgaugcuuuccauuggguucuuaaaaaggaucuaug

SEQ ID NO: 2250539 - RNA, 81 nt, Homo sapiens
gguacugcauucaagugaugugauucuucuuuuuggguucugccaacaggaagcauugaacauaucacuuggcucaguacc

SEQ ID NO: 2250540 - RNA, 63 nt, Homo sapiens
cuauguauccauguguucucaucauuuagcucccacuuacaagugagaacaugugguauuugg

SEQ ID NO: 2250541 - RNA, 66 nt, Homo sapiens
ucucgagaguuccagugacuguugcaaaugccuuuaacucuucagcucacugugaacuucuugagg

SEQ ID NO: 2250542 - RNA, 71 nt, Homo sapiens
gugagaucuguuuugagaaaugcaugcucgggcgauaucacugucgugcagaccucacagcauucacucac

SEQ ID NO: 2250543 - RNA, 97 nt, Homo sapiens
gugauugcaaaggucacuguucagauccuuauuccuuacuggcccuaaauucagacuagauuggacugagaggacuacaguguauuugugcauucau

SEQ ID NO: 2250544 - RNA, 67 nt, Homo sapiens
gggugggaugggaggaaggaggcccuugaagacauuuugcaagacuaaaccuuccccucagcuaucc

SEQ ID NO: 2250545 - RNA, 55 nt, Homo sapiens
aguaauacuuuugggauauuagauucaaauaucuaauuuucucgaagguaucacu

SEQ ID NO: 2250546 - RNA, 59 nt, Homo sapiens
guggcauacagcagacaccuuugggugaauuagaagaaggugcucuuccuguaggucac

SEQ ID NO: 2250547 - RNA, 68 nt, Homo sapiens
ccuauaaaaugccauguggagcaccccagaugaagcagcugguaugcuucauaugcaaaccauguggg

SEQ ID NO: 2250548 - RNA, 98 nt, Homo sapiens
cuggugacauuaaaucagucuuucaucuggcgaaugugaagagugccuaauauguaggaggcauuguucuagguccuaggauguaagagaugaaccag

SEQ ID NO: 2250549 - RNA, 81 nt, Homo sapiens
cuagggcuaauuaugcuaagugaaauaggccggucacagaaggacaaauaccacacgauuccacuuacaugaaguaccuag

SEQ ID NO: 2250550 - RNA, 72 nt, Homo sapiens
aauuauuucaauugauaaauuugugcaaugugcucacauacaucacuggcaaauauauccguugggauaauu

SEQ ID NO: 2250551 - RNA, 77 nt, Homo sapiens
uauucacaagaguuucacugcaaacugacuuuucagggcaaauucaccacccaaaagucuguagugaaaggugaaug

SEQ ID NO: 2250552 - RNA, 63 nt, Homo sapiens
cgauaaguauuuggacuuuacugugaguaagaggagccacugagaguguuaaauacuuaauug

SEQ ID NO: 2250553 - RNA, 60 nt, Homo sapiens
aaucugggcugauucuguuuuuuaauauguauguaaauguuaaagagcucagcacagguu

SEQ ID NO: 2250554 - RNA, 75 nt, Homo sapiens
ugauuagaguuuucuguguugucauuauuguaucuccuguuaauacagugucugacacguaggaagcacuaauua

SEQ ID NO: 2250555 - RNA, 126 nt, Homo sapiens
uagucccagguacuuaggaggcugagguaggagaauugcuuggacccgggagguuggcucacugcaaccuccaccuccuggguucaaacagucucccugcuucagccucccuaguagcugggauua

SEQ ID NO: 2250556 - RNA, 78 nt, Homo sapiens
ucacugacauuacucguucaugagcacaauagauucauguguuucccacaagguacaugcucaugaguaaugcaguga

SEQ ID NO: 2250557 - RNA, 125 nt, Homo sapiens
gcauggagaauggugcaguaccuguguagacauggcccuugggcagugugcauguguaugcuauagagagugggaaugcuguguacacugaaugagugggcuuggacaucuguggugacaugugc

SEQ ID NO: 2250558 - RNA, 66 nt, Homo sapiens
gugucagaaucugagacgacaacauuaggugcuugcaccugacguugucaucugagauucugacac

SEQ ID NO: 2250559 - RNA, 56 nt, Homo sapiens
guggcaaguguuccaagaggcgauuuauucuuucugcugauggacacacuugccau

SEQ ID NO: 2250560 - RNA, 81 nt, Homo sapiens
aacucgugguaaaauggcauagagcuacacacacacauugcaccaaugucaauuuccugguuuugauauuauacuacaguu

SEQ ID NO: 2250561 - RNA, 74 nt, Homo sapiens
acagaugagauguucucauggauugugaccucaccuccuucaaaucuugguucaagggauacugucucauuugu

SEQ ID NO: 2250562 - RNA, 130 nt, Homo sapiens
gcauccugagagccuuggaagagggaacagauuugaggcacuguccugacagucacccuggugcagucaguggagagcuuccaggauucauaucccuauaacccagggccacacuucucaacccugaugc

SEQ ID NO: 2250563 - RNA, 83 nt, Homo sapiens
cugacucugagccgauguugacaccaggggacccaaaacaucauugucauccuccaguuaaaauaggggcuuauggaggucag

SEQ ID NO: 2250564 - RNA, 56 nt, Homo sapiens
gagacacugggauucuuuugaucugggaucccauguuccugagauucccaguucuc

SEQ ID NO: 2250565 - RNA, 61 nt, Homo sapiens
uuucuaguuuaacugguacuucaagucuucauucccuaaugaaggcucagugucauggaaa

SEQ ID NO: 2250566 - RNA, 89 nt, Homo sapiens
ccugagcuuuuccacaaaaucaaugguucccaaguaauucauucuaaaacuaaugcuugagacacauaugaauuuggaggaaccuuagg

SEQ ID NO: 2250567 - RNA, 67 nt, Homo sapiens
uuauuagguuagugcaaaaguuauugcaguuuugcuauuaaaaguaacuuuugcaccaacccaauag

SEQ ID NO: 2250568 - RNA, 88 nt, Homo sapiens
augaccuuuacaauuuugaggaguauuuugucgaauguccuauauuugggauuuuucugagauuuuuucaugauuaggugaggguuau

SEQ ID NO: 2250569 - RNA, 123 nt, Homo sapiens
ggaauuucuucucuugcuuuuuacaaagugagaauucuggaccucaccccauagcaauggaagcagaauccauggacugaggugcagcaauccucauguguaacacauaacuggaauaauucc

SEQ ID NO: 2250570 - RNA, 70 nt, Homo sapiens
uaugagacuccugugcauaucuuggacugugugggccuccacacagucucacgguagcaucagccucaug

SEQ ID NO: 2250571 - RNA, 67 nt, Homo sapiens
ugauaguugucagugggggaccgcucugagcuccuagaggcugcucuucuccacagauaauuaauca

SEQ ID NO: 2250572 - RNA, 91 nt, Homo sapiens
cccagucacagaggauaaaucuuggcuagucuaagcuagugcuaguagucgcauuuccuuuugccaaugauuuauuucaggugaucauggg

SEQ ID NO: 2250573 - RNA, 76 nt, Homo sapiens
aagccagugugacaggaaacuuugugucuucugugugacauaaaaccauccauuguuucuuaaauuccauuuguuu

SEQ ID NO: 2250574 - RNA, 125 nt, Homo sapiens
aauuuuagacuuguaucucuuuguaaggacccuuggaaauuaacagggauuguccauacucugagaggaaguggcuucucugucuaguuucuaccacuuauaauuauguuggucuuuuuaaaauu

SEQ ID NO: 2250575 - RNA, 55 nt, Homo sapiens
aggccuuugguuuccccagcugugaaacucccacaugggguagaagagaaggcuu

SEQ ID NO: 2250576 - RNA, 59 nt, Homo sapiens
gcaaugucugugcuaaaaacugggaauacaguggucaaaaauuuagacagacauccugc

SEQ ID NO: 2250577 - RNA, 82 nt, Homo sapiens
ucaaaaaucaguuggcuauagauacauggauuaauuuuugcauucccuguuccacuaguuugugucuauugugcuguuuugg

SEQ ID NO: 2250578 - RNA, 112 nt, Homo sapiens
ugcagcacgagcccucucccccuucuccccuuuaguuucuuaauaagcacaauaaagacauaugugcuuauuaagaaacuaaagaggcccggcgugguggcucaugccugua

SEQ ID NO: 2250579 - RNA, 70 nt, Homo sapiens
guugcucaggccggagugcaguggcacgaucuugguucauugcaaccuccaccuccuggauuugagcgau

SEQ ID NO: 2250580 - RNA, 64 nt, Homo sapiens
auugugaauagugccacaauacacauaugcgugcaugugucuuuauaguaguaugauuuacaau

SEQ ID NO: 2250581 - RNA, 86 nt, Homo sapiens
ugucagaguaaguauauggaauaauguugguccugaaugcucugugacauucauggguuaauuuguucgauaaaaguacugugaua

SEQ ID NO: 2250582 - RNA, 64 nt, Homo sapiens
acugugaauagugcugcaauaaacauacgugugcaugugucuuuauagaagcaugauuuauagu

SEQ ID NO: 2250583 - RNA, 63 nt, Homo sapiens
acauuucuugcauauucucugaggcaggagagaccuucucuuauucuggauaugcagagaugu

SEQ ID NO: 2250584 - RNA, 69 nt, Homo sapiens
ggugaaaagaugagcaccauacacagcagccuggccauuggucauguguauggugcuaaucuuuucacc

SEQ ID NO: 2250585 - RNA, 130 nt, Homo sapiens
ucuuggccaaugugaauaguacuucuaucaacaugagagugcagacaugucucaaacauaagaaaaucaguaugucaaagagacaucugcacucccauguugauugcggcacuauucacaguagccaaga

SEQ ID NO: 2250586 - RNA, 66 nt, Homo sapiens
uagcuguuaauauacaaaugguggaaaguauuauugccuaucacaguuuugaauauaaugcagcua

SEQ ID NO: 2250587 - RNA, 109 nt, Homo sapiens
cccuuugcauuuacauuuuucauauuguccuuuaaugugcagugaucauugauuguccauugauacugugcauuagaggcuaucuggaaauuguuguauguagauaggg

SEQ ID NO: 2250588 - RNA, 69 nt, Homo sapiens
cucuauugacuauaaauaagcaagggcugggauuauggccuauuugcccuuuuuaaagucuccauagag

SEQ ID NO: 2250589 - RNA, 76 nt, Homo sapiens
ugucuuuaucagcagcaugaaaagcaacuaauacgguaaauugguaucaguugagugaagugcuucugauaagaua

SEQ ID NO: 2250590 - RNA, 87 nt, Homo sapiens
ucacuauguugccuaggcuggagugugguggcuauucacaggugagaucauagcacacuauagcuucaaaccccugggcucaaguga

SEQ ID NO: 2250591 - RNA, 97 nt, Homo sapiens
cccaaguguuuugaaugaguggaugagugaauuguucaacaggaggacacccacaaggggucccgauucugcgguccaguucaaccaagagccuggg

SEQ ID NO: 2250592 - RNA, 76 nt, Homo sapiens
ccccagcuuuuugagguauaguguggcuaguggcuaauuuucuuuugacugguugggaaugcuucaggaagggggg

SEQ ID NO: 2250593 - RNA, 55 nt, Homo sapiens
aacacagcaucccuuaggucgucaugcaaaaguaaugauaugguuuggcuguguu

SEQ ID NO: 2250594 - RNA, 94 nt, Homo sapiens
gcuguauaguauuccaugguguauaugugcuauacccacaggauuauaaaucauucuacuguaaagacacaugcacacguauguuuauugcggc

SEQ ID NO: 2250595 - RNA, 129 nt, Homo sapiens
guucucuuaccaguggcucaaacuuggucgccuuugcucagauuugcuuuuguuaauucccccaaaaaaccacuaauuuaaggcuguuguguaauaggauuuacuaaagguuugaacaaaacagagggu

SEQ ID NO: 2250596 - RNA, 81 nt, Homo sapiens
caggagaucagaguuagaauuguacugcaaucaggggaauauuuugccuugacuacgguucaguuaaaaguucauuuccug

SEQ ID NO: 2250597 - RNA, 67 nt, Homo sapiens
aagggacagccauggggcgcagccaacggggaguuauaaaggugguuaacagcacaugcugucccuu

SEQ ID NO: 2250598 - RNA, 75 nt, Homo sapiens
uguaauuauguaguuucauagaacacaguaauggagcugauuuaacugccuacugugcaaauaugcaugaauaca

SEQ ID NO: 2250599 - RNA, 64 nt, Homo sapiens
acaaaggaaauaggauuagcauaguuuuuuaauucacacugacugcuacugucacuuccuuugu

SEQ ID NO: 2250600 - RNA, 73 nt, Homo sapiens
ugcuauggaaaaauucugagcaggaaucaguagguaugauugaaauuaaugcuuuugggauauuucucuggua

SEQ ID NO: 2250601 - RNA, 66 nt, Homo sapiens
ggcaugugggauugugaaaugcugggggacaaggacuucuggguuuuuacaauguuuacaccuguc

SEQ ID NO: 2250602 - RNA, 71 nt, Homo sapiens
auuaagaccuaucucucauaccuuuugauuuacaaauuuguaaauuggugaccaagggaaggacucuuagu

SEQ ID NO: 2250603 - RNA, 130 nt, Homo sapiens
ccccuaaaauaacauuaaagaaggagguaagagucaaaacaaucgcuuuugguaggcaaggacuucaugucuaaaacaccaaaagcgauuguuuugacucuuaccuccuucuuuaauguuauuuuagggg

SEQ ID NO: 2250604 - RNA, 55 nt, Homo sapiens
uaacuccauuuggacucaguauugugucuuugacucugagaccaaguggcaguug

SEQ ID NO: 2250605 - RNA, 89 nt, Homo sapiens
uuuuuaauuccuuguucaguuuccuugauacuaguuuugguaaagucuaagacuaagacaguauuggcaaaguguguaggaguuaggaa

SEQ ID NO: 2250606 - RNA, 68 nt, Homo sapiens
gccuggucaacauggcuaaaccccaucucuacuaaaaauagaaaaguuagccggguguguuggcgggc

SEQ ID NO: 2250607 - RNA, 55 nt, Homo sapiens
cugucuguuuggggaccuguggccaaggggacccuggcccgggacaagcaggcag

SEQ ID NO: 2250608 - RNA, 104 nt, Homo sapiens
gaaauacuacuuagugguuacguugugguuuuuaaaacuagguggauuuuuuuaauugucuaccuuuaauuuagaugccacgucuuuccaauuaagaauauuuc

SEQ ID NO: 2250609 - RNA, 82 nt, Homo sapiens
guccuguaagugaucaguggaugaacaagaagugauauuuacauguaaucauauaauggauuauucagugauaaaacaggau

SEQ ID NO: 2250610 - RNA, 60 nt, Homo sapiens
ggagccagaaaugcugugguuggggcauuucaucaaccaaaucacaguuguucugccuuc

SEQ ID NO: 2250611 - RNA, 75 nt, Homo sapiens
uaguuuucuccucuauuucuguauguauuuccuuaauauguaguuucagaaguggaauuuauuagagauaaacua

SEQ ID NO: 2250612 - RNA, 70 nt, Homo sapiens
ugacaaaaccuuuugugacauaccuauauuugaaaaaauauauggccugaauuagaaaaguguuagguca

SEQ ID NO: 2250613 - RNA, 70 nt, Homo sapiens
auauccucucuagcaccuguuguuuccugacuuuuuaaugaucaccauucuaacuggugugagaugguau

SEQ ID NO: 2250614 - RNA, 70 nt, Homo sapiens
agguucggauugccaguauuuuguugaggauuuucgcaucgauguucaucaaggauauuggccugaaguu

SEQ ID NO: 2250615 - RNA, 88 nt, Homo sapiens
cacacacaaaaagcucagagucaagcucuuguuccaucucuuacugccugaaugacugggauuuuucuugacucuguuucagucugug

SEQ ID NO: 2250616 - RNA, 64 nt, Homo sapiens
guggccagaugucccucucagguuuguuuucucuaaaauaauccugucuugaccaucaggcuac

SEQ ID NO: 2250617 - RNA, 115 nt, Homo sapiens
ggucucaugcugccacccaggugggaguacagugcuguggucaugggucugugcagccucaaacuccugggcacaagccauuccucucaccucugcuuucuguguagcugggacu

SEQ ID NO: 2250618 - RNA, 76 nt, Homo sapiens
agguccaugcauagccauucauucguugauucauuccuuaaccaagaauuaaugagugcuacucugugcagggccu

SEQ ID NO: 2250619 - RNA, 70 nt, Homo sapiens
uuuaacacuguguauuuaauuacauauuaugggaauaccaugaucuguguuuguaugcauaagaauuaga

SEQ ID NO: 2250620 - RNA, 112 nt, Homo sapiens
uucgugauguauuauuuacuguuaggcaauggagauagaggauguuuuacugaguucacacucagacauuccugugaccauucuaaaacaaccaguucuaccucauccugag

SEQ ID NO: 2250621 - RNA, 76 nt, Homo sapiens
gaaccuucuuccaugaauuaguuaccucugugaaccccaaauaucugagacaggucuuaguucauuuagaagguuu

SEQ ID NO: 2250622 - RNA, 114 nt, Homo sapiens
gcaaaggucuaacagggguauugauaucagaguggguuuuaaaaguguauuaacuauaaucuuacuuuuagccuauuugauucuacuuauuucagaacuauuaaugacguuugu

SEQ ID NO: 2250623 - RNA, 80 nt, Homo sapiens
gcucaguguguuguugauugaauuuacuuuucauucuaaugaacuugagaacauuaauaguuaauuuugccaugcugagu

SEQ ID NO: 2250624 - RNA, 78 nt, Homo sapiens
augggaagagaccccuagagauaggaggaacguuauuugguuagguucugguucugcucucuggggaaagcuuccuau

SEQ ID NO: 2250625 - RNA, 88 nt, Homo sapiens
cccuuuagugagguuggaaaaguuuucuuggacaauauucugagauauguuuuccaagaugcuuacuuucuccgcaucucuuccgggg

SEQ ID NO: 2250626 - RNA, 83 nt, Homo sapiens
ccugauucauccuugaagccaaccugccugaucagaauauccaugcuucugacuugaguaacuggcucagggaugugcacagg

SEQ ID NO: 2250627 - RNA, 62 nt, Homo sapiens
uugugaauagugcugcaaugaacauacaugugcaugugucuuuguagcagcauaauuuauaa

SEQ ID NO: 2250628 - RNA, 73 nt, Homo sapiens
gcauguucuggagagguaagacuuuuaguugauuuuccauuagugagcuaacauuuuuccucuuccaacaagc

SEQ ID NO: 2250629 - RNA, 55 nt, Homo sapiens
uuggaagguaaucaaaaguucucucagaggucagggagaggggagggccuuccaa

SEQ ID NO: 2250630 - RNA, 58 nt, Homo sapiens
guguauguguauguguguguuugugugugugugcgcacagaugcaugcacauaaacac

SEQ ID NO: 2250631 - RNA, 76 nt, Homo sapiens
uucagcaaaaguguaagacuuauuuucuuuaucaggaauucauuguuuacugaaaguuuaagacuuguaugcugaa

SEQ ID NO: 2250632 - RNA, 97 nt, Homo sapiens
uuccuguggcgugccguuuuacaguaguaucuucauuuguugauucauucacucagucaacauuuaguaaauauuaugugacaggcagccaugggaa

SEQ ID NO: 2250633 - RNA, 62 nt, Homo sapiens
ucuacuggcagacaaauuugagcauauuuucaucaaaugugaucucauaugucugggguaga

SEQ ID NO: 2250634 - RNA, 76 nt, Homo sapiens
ucacuugaagccaggaggcagaguuugcagugagcccagauggugccacugcacuccagccuuggcaacagaguga

SEQ ID NO: 2250635 - RNA, 85 nt, Homo sapiens
gaagguauuuaguaguaucacggugucugcguugcugacuugcccucucagcauuucaaaggcugugaugcuuguaaauaaauuc

SEQ ID NO: 2250636 - RNA, 61 nt, Homo sapiens
uuguguaguaccucucacauugaaugggacugacuugucuagccaauaggauauuacacaa

SEQ ID NO: 2250637 - RNA, 57 nt, Homo sapiens
ggaggaggagaggcugccauugauucaaaaauaacaugagcagaugcuccugccucu

SEQ ID NO: 2250638 - RNA, 60 nt, Homo sapiens
uugagccaugaucacaccacugcacucaagccugagugacagugugagauccugucucaa

SEQ ID NO: 2250639 - RNA, 100 nt, Homo sapiens
aagaagaauuuagcuuuguaaugacaagaacuuuccauaguaauuccucuaaauguuuaggaccuuauuagggugguuuauguucugugauauucuuuuu

SEQ ID NO: 2250640 - RNA, 72 nt, Homo sapiens
uuggugagggugaucuuguucacucagacaauugauuccaaugcugaccucugucaaagacacccucacuga

SEQ ID NO: 2250641 - RNA, 78 nt, Homo sapiens
ucugguuucguguguguguguguguguguguguguguguguguguguguaucaugcacaugcauagguaugauacaga

SEQ ID NO: 2250642 - RNA, 90 nt, Homo sapiens
cauccuccuggcauaugaggaguauaacccggugaguauucccggcagugagguucccgggccauauuuccauauugacaggagugggug

SEQ ID NO: 2250643 - RNA, 59 nt, Homo sapiens
cuguaacagaauaaauuuguuugguuuuaagcuaccaaauuugcaguaauuuguuauag

SEQ ID NO: 2250644 - RNA, 73 nt, Homo sapiens
gccuucucaguuuucuggggaagaaacccaagaugccugacuuucugccuuggagacugaaagaaacaagggc

SEQ ID NO: 2250645 - RNA, 60 nt, Homo sapiens
aaggaugaugguaugauuaaauggaugaaauucuuuauguauuagacuugccuuauccuu

SEQ ID NO: 2250646 - RNA, 55 nt, Homo sapiens
uauuucuuucuugauauuuuggcugcucauaaugucaguuacugagagagaagug

SEQ ID NO: 2250647 - RNA, 69 nt, Homo sapiens
ggggucagucagguaccugaaagcagccacagucucaacauuggcuguuugcagugccugaaggaccuc

SEQ ID NO: 2250648 - RNA, 67 nt, Homo sapiens
uuggagcccauccagguacagggagggccuccuuaaagcccaaaaucugacucugugaugggcccaa

SEQ ID NO: 2250649 - RNA, 86 nt, Homo sapiens
ggagaaucaccugaauccaggaggagguuacagugagccaagaucgugccauugcacuccagccugggugacaagagugaaacucc

SEQ ID NO: 2250650 - RNA, 90 nt, Homo sapiens
caggggaaucacuugagcccaggagauggagguugcagugagccgauauugcuguugcacucuagccugggcaacaagaaugaaacccug

SEQ ID NO: 2250651 - RNA, 77 nt, Homo sapiens
ucgcuugaacccgggagguggagguugcagugagccgagauugcgccauugcacuccagcuugggugacaagagcga

SEQ ID NO: 2250652 - RNA, 84 nt, Homo sapiens
ucucagauuauuucagaaggugguggugacucuggcuuuuguaguagagaaagcuuccccaggguccccuaccuuuugaugagg

SEQ ID NO: 2250653 - RNA, 86 nt, Homo sapiens
guuguuguaucacugagcuuguguucaaggaacaccuauuuuacuuaguaauggcccuaaaacacaagaguagugaugcuggcaau

SEQ ID NO: 2250654 - RNA, 129 nt, Homo sapiens
aguagccaucucaguuaucagacuguuguggcauaaaagcgcuuguguucuuguauccuuuauuuuacuuaauaauggcaccaaagcacaagagcaguuaugcuggaauacuguuauaauuguucuauu

SEQ ID NO: 2250655 - RNA, 103 nt, Homo sapiens
uugagauggagucuugcucuguugcccaggcuggagugcaguggcgugaucucuacucacagcaaccuccgccucccggguucaagcgauucuccugccucag

SEQ ID NO: 2250656 - RNA, 55 nt, Homo sapiens
gucaggaucuguguucauucugccuugaugagaggcagagcaaagcaguccuggc

SEQ ID NO: 2250657 - RNA, 98 nt, Homo sapiens
gcagaauaugaaauuaguuggaauuuuacuucuguaagaauucugaaaauagagccucagacucucuugcauuguaagguuucugcugagaagucugc

SEQ ID NO: 2250658 - RNA, 103 nt, Homo sapiens
gcccugacaggugaccaccuguggcuugaagguucuuucuuggcauuguccuaaaaccacugaggugagaacugcuggggccacaggcaggcuccugaggggc

SEQ ID NO: 2250659 - RNA, 80 nt, Homo sapiens
aaauaugacacagugggauggaaaugggcuucaggaaccagaaggcuuggguucaaaucucauccugccugucacuauuu

SEQ ID NO: 2250660 - RNA, 82 nt, Homo sapiens
aguuuuaggguacaugugcacaacgugcagguuuguuacauauguauacaugcgccauguuggugugcugcacccauuaacu

SEQ ID NO: 2250661 - RNA, 69 nt, Homo sapiens
ucucccuuugcugaauguuuuucccacagauauuagauaaaauguagaguugucauucagggagggaga

SEQ ID NO: 2250662 - RNA, 101 nt, Homo sapiens
ucagaucaucaggcauuagguucucauaaggagugcaugaccuaggucccucacaauagggucuggccuccuaugagaaucgaaugcugccacugaucuga

SEQ ID NO: 2250663 - RNA, 78 nt, Homo sapiens
cugaauucuauguuguuagacccaccagagaaggaaggcgauagauucucuaaaggucgaaagcauggaaaaauucag

SEQ ID NO: 2250664 - RNA, 129 nt, Homo sapiens
cuacuucagaucaucagucauuagauucucauaagaagcacgcaaccuagauccguugcauacacaguucacaguaggguuugugcuccuaugagaaucuaaugccaccgcugaucugacaggaggugg

SEQ ID NO: 2250665 - RNA, 76 nt, Homo sapiens
ucaccauucugacuggugugagaugguaucucacugugguuuugauuugcauuucucuaauagucagugauguuga

SEQ ID NO: 2250666 - RNA, 100 nt, Homo sapiens
caggugugauuauguucauucuccaggugagguuaagggacuuacugaaauucuguguggucuauggccauaccaugcugaaugugcccuaucuuaucug

SEQ ID NO: 2250667 - RNA, 74 nt, Homo sapiens
ugagcauuuuaauaaaggggcuuagaaaugaguagaauuucacuagccagcccuuuauuauaauagauuguuca

SEQ ID NO: 2250668 - RNA, 56 nt, Homo sapiens
ugcauggaggagcuccccgcagggucuucugucugggggcagagcuucuccaugca

SEQ ID NO: 2250669 - RNA, 89 nt, Homo sapiens
gggcaccagccaaagcacagcuuauuuuaugccauuaccgcuauuggaauaguacaaaaugugccuacagugggcuguuggaccugcuc

SEQ ID NO: 2250670 - RNA, 82 nt, Homo sapiens
gaaauaaugauuuuaaggcuauuugagaauguguguggucaucucuaugcauuuguuaaaagccuuuuuuauccuguauuuc

SEQ ID NO: 2250671 - RNA, 90 nt, Homo sapiens
cuguggguagauacccaguggugagauugcuggaucaaaugguaguucuacuuuuaguucauuaaggaaucuccccacuuuuuuccauag

SEQ ID NO: 2250672 - RNA, 77 nt, Homo sapiens
gggugccaggccacucauucauuccuugacauccauggcacagccagggcaguuaagagugggaguuggccacaccc

SEQ ID NO: 2250673 - RNA, 60 nt, Homo sapiens
cugcaauguuugaaauggcaaacauagugaaugggaugaauggcagauuagacauugcag

SEQ ID NO: 2250674 - RNA, 62 nt, Homo sapiens
gcaggcagaaaaaugugaaaagagagacuggccuagucucccagccuacauauuucuccugu

SEQ ID NO: 2250675 - RNA, 96 nt, Homo sapiens
uuuuauuuuaaggagaaugggucauauuuuccacuuuaucaguggcauuauauuguuugauaagaaaaauauaccagacuuccauaauauuuaaga

SEQ ID NO: 2250676 - RNA, 65 nt, Homo sapiens
uuagccaggcaugguggugugugccuauagucauagcuacuagucauagcuacuugggaggcuga

SEQ ID NO: 2250677 - RNA, 65 nt, Homo sapiens
cccagauguuuuauuaauuauacuccuuuucaugacucaggaaggcuaagaugaagcugucuggg

SEQ ID NO: 2250678 - RNA, 56 nt, Homo sapiens
ugggaucauucaaugacgaaaucgccuaaagacgcauuucucagaauguauuccca

SEQ ID NO: 2250679 - RNA, 68 nt, Homo sapiens
cucaucacauuuauaauuaauuaguuauuuaauuaccacauucccuauuugauuguaagcuuggugag

SEQ ID NO: 2250680 - RNA, 63 nt, Homo sapiens
uauccucucuccgcaucacagcaugugauaagccuuuuaaaugugugcuuggagagcaggaug

SEQ ID NO: 2250681 - RNA, 75 nt, Homo sapiens
uucaccagaguuggaauaauuuugaccaaagcauuuuuacuuauaaacauagggucaaaguguucuuuuguugaa

SEQ ID NO: 2250682 - RNA, 84 nt, Homo sapiens
uuuguauucauuuccgguuuguccugccaugguuuauuuuugcagaaauaagcacaugcgggcacauacaugguugugcacaaa

SEQ ID NO: 2250683 - RNA, 78 nt, Homo sapiens
uuuaacaugaaagaauuaaauaaagucaagcaugagauggauuuugaugcugaguggcuauuugaaaaucaugaugag

SEQ ID NO: 2250684 - RNA, 61 nt, Homo sapiens
cuugugggaggugauuagaucaugggggcuguucucaugauagugagugauuucucacaag

SEQ ID NO: 2250685 - RNA, 90 nt, Homo sapiens
ucucacagcacaacaccuucuugcacuuggcccucauuagcccauaccucuggaggagcuagagggucagguucaggaaaaacugugaga

SEQ ID NO: 2250686 - RNA, 70 nt, Homo sapiens
gcaaggguuucaccuggaguucaggauaagaaggaaacacuuuuuaccugaggaaggugagcccccuuuc

SEQ ID NO: 2250687 - RNA, 82 nt, Homo sapiens
gcuauuuuuuaucccuuuuuucauuaaagcaagguuguuuaugugcauuuuuguucaccucaaggaugggagagagaagagc

SEQ ID NO: 2250688 - RNA, 60 nt, Homo sapiens
aggaaauguuuagcauccacuuuuaaaagcaugaggagaggggagagcuaagcaauuccu

SEQ ID NO: 2250689 - RNA, 99 nt, Homo sapiens
guuaucccagugauuguauggugaagguagggacugcuaaaacaaaauccaaauauaguacucaaaacucacuuuagcuaacaauccugauggcauaac

SEQ ID NO: 2250690 - RNA, 58 nt, Homo sapiens
uggacugagauuucagcugccacccauggcagguggcacagcuugcaauuuaagucua

SEQ ID NO: 2250691 - RNA, 59 nt, Homo sapiens
gaacuaauuuacauucccacuaacauuuauacacuguuggugggaauguaaauuaguuc

SEQ ID NO: 2250692 - RNA, 86 nt, Homo sapiens
uguggguacaaaacagguguauuuucuguagagaauuuugaaacaauaauaaagaugacugaaagguauacgcuuguuauccuaca

SEQ ID NO: 2250693 - RNA, 56 nt, Homo sapiens
agagaaauacugcuguguucuguaugacuucacauacuguaaugguaguguucucu

SEQ ID NO: 2250694 - RNA, 94 nt, Homo sapiens
gaugugcagaugagauacaucuaugugucuguguauguaugaugugauuuggauguguaugggcauauggaugugugucuauaucagguauauc

SEQ ID NO: 2250695 - RNA, 71 nt, Homo sapiens
gcaugaauugauucccuguggcauccuuaggagugacguucuuuuuagcaaugcuguggggaaguucaugu

SEQ ID NO: 2250696 - RNA, 82 nt, Homo sapiens
aguuuuaggguacauaugcacaacgugcagguuuguuacauauguauacaugugccaugcuggugugcugcacccauuaacu

SEQ ID NO: 2250697 - RNA, 82 nt, Homo sapiens
caggcacugucauggcauuuguaaacugccauggcacuggugggagugucuuuuagcaugcaaauguaugacaauuagccug

SEQ ID NO: 2250698 - RNA, 61 nt, Homo sapiens
aucuuguuaguuaugugcggguuugguuauuaacagaccuuguagcaaaccuaacauaggu

SEQ ID NO: 2250699 - RNA, 64 nt, Homo sapiens
uucugcuaccuuucuguaccuuaaggaacaaucauucaaggcauuuuacagaacuggaguagaa

SEQ ID NO: 2250700 - RNA, 84 nt, Homo sapiens
ugaguguauguguguguguacacuuagggguguguaugugaauccaugucugagugucccagugugcauacaggugugugcuca

SEQ ID NO: 2250701 - RNA, 116 nt, Homo sapiens
cuauguuuucuccuaaaaguuuucuaguuuuacauuuugcauuucgaucuuauagugcacucugaauuguuuacgagaugugagauuuagguagacuuuuauuuccguuugcaugg

SEQ ID NO: 2250702 - RNA, 56 nt, Homo sapiens
cuuccugcagaagcacacagccucaggagcuuccgaacugugcauuucuguggaag

SEQ ID NO: 2250703 - RNA, 73 nt, Homo sapiens
aaggcucaauaguagcaugcaauauuauagagaugguuuuacaucuguuuugcauaauguucuuuugguccuu

SEQ ID NO: 2250704 - RNA, 91 nt, Homo sapiens
ucaaaaagauaaaagauaaguauuagugaggauauggaacccuuguauacugaggguagcgguguaaauuaguacagucauuacuuuuuga

SEQ ID NO: 2250705 - RNA, 86 nt, Homo sapiens
guuacuucucuguggcaguuuguuugugagguccagauuauguuacuaucuaucucacagguaacuguaggcucacaugagagaac

SEQ ID NO: 2250706 - RNA, 76 nt, Homo sapiens
ugagaaacuuuuacuagaaccuuauucagagugauuucucuuucucugagauugguucuguguuaguccauuuuca

SEQ ID NO: 2250707 - RNA, 69 nt, Homo sapiens
uucucagauggggccaaguccuucugugaagccaaaaaucuuucauggaggauuugcuucuuuugagga

SEQ ID NO: 2250708 - RNA, 62 nt, Homo sapiens
ugccaugaagagaggaagcagugaugucaggcucauaggaucccugcucccuccuucuggca

SEQ ID NO: 2250709 - RNA, 75 nt, Homo sapiens
ccccagcauuugugaauguuuucuuacaugguaaagagacuuugcacaugugaugaacaaucuugaggccagggg

SEQ ID NO: 2250710 - RNA, 61 nt, Homo sapiens
gucuugaugggaagcucugccauguggaaggaucacaucucagguuucuugacaacuggau

SEQ ID NO: 2250711 - RNA, 129 nt, Homo sapiens
ggauccaaaguagagcuucuaaugaccccaaggaguauugaaugaccaagugagguacccaccagacccacuguguccauuacucucuuggaacaacuggggaucgugguuaaguucucucuuggauuc

SEQ ID NO: 2250712 - RNA, 88 nt, Homo sapiens
gaguaaacaaagugcaugacugauauuugagauacuucaugccuuaucucuggauaucuacuuauguucuauuuucauuuguuuguuu

SEQ ID NO: 2250713 - RNA, 70 nt, Homo sapiens
uagugaaguaguaaaauuuauugcagcaguccuaucuguuuauucugcagaaguuuuauuauggacauua

SEQ ID NO: 2250714 - RNA, 72 nt, Homo sapiens
gaguuguugcuuaaggcuuguacuuguuuucuauugccguguaacaaacgaccagaagcuuaaagacagcuc

SEQ ID NO: 2250715 - RNA, 126 nt, Homo sapiens
aagagaacguuguaauacuucuggcuuagaauguaggugauguguuuguucuaucucuuuuauaaccaaagacgggauggugacauauaacuaggcacagcuaauaggcaugauaaugacucucuu

SEQ ID NO: 2250716 - RNA, 59 nt, Homo sapiens
cggggacacacuggcagcuccuaccaauuagugaccuaacccugccagugugcucuccg

SEQ ID NO: 2250717 - RNA, 78 nt, Homo sapiens
gugaggcccaagacacucucuucugcugcaacauugauauuuaauguugagggaagccagaggucugcacaaccucac

SEQ ID NO: 2250718 - RNA, 94 nt, Homo sapiens
gcuuugcgcuaauggacuguuauaaaaugcacaguuguuucuugcagucacugccaaaugccucccauucuacugacaguuuugugcauuaggc

SEQ ID NO: 2250719 - RNA, 63 nt, Homo sapiens
aucagugcagugggaacuagaaauaagcaucacauuguauguucugaaaaccauugaacugau

SEQ ID NO: 2250720 - RNA, 129 nt, Homo sapiens
uuuggggauguguacuuuuuuguccuccauccuucuucacaugugcguuuuggcauguguuauaacuuggcacuaaaaugcacaugugaagaaggaaggaggacagaaaaaagaguacccauccccaaa

SEQ ID NO: 2250721 - RNA, 73 nt, Homo sapiens
gguaauauuggcagaauguuagaaacuuaaacaguucaccuuagcuuagguuagauauucucccacuauugcu

SEQ ID NO: 2250722 - RNA, 89 nt, Homo sapiens
auuauaugguuuuugucguugguucuguuuauaugcuggauuacauuuauugauuugcauauguugaaccagccuugcaucccagggau

SEQ ID NO: 2250723 - RNA, 99 nt, Homo sapiens
ugugaaagggacaugagauuugggaggggucaggaguggaaugauaugguuaggcuuuguguccccacccaaacaucaccuggaauuguaauccccaua

SEQ ID NO: 2250724 - RNA, 57 nt, Homo sapiens
guucauguuuucuuucacuuugucaguguaucacaugaagugaguguuaaacugaac

SEQ ID NO: 2250725 - RNA, 64 nt, Homo sapiens
uuuaguuugccaguauuuuguugaggauuauugcauugauguucaucaagaauauuggccugaa

SEQ ID NO: 2250726 - RNA, 61 nt, Homo sapiens
gaagaguaauuaagcuagaaagcaaggaagagauucuguguaaagcuaugaauuauucuuu

SEQ ID NO: 2250727 - RNA, 76 nt, Homo sapiens
uucaguauaaguuggugcaaucauguauuucauuauguugucugauggagucgugcccuugcauuuauauauugaa

SEQ ID NO: 2250728 - RNA, 130 nt, Homo sapiens
ggcugagugcugggagagaagccgaggugggcuuggaacauguccgggguccgggguccggggucuaaaaccucucauggccuuuggaaugugucuagacuugcuggcuccuugcuucuagcacucccau

SEQ ID NO: 2250729 - RNA, 78 nt, Homo sapiens
augcucuuagugcauuuguucugugucaggcacuguuuuccauaguguuuguccagugccaggugcugcuguaaguau

SEQ ID NO: 2250730 - RNA, 71 nt, Homo sapiens
ugaaugucauccaugaucacauaaccaggugcauuccagguauccuaaaaaugucauggaugacuaauuca

SEQ ID NO: 2250731 - RNA, 59 nt, Homo sapiens
uagagacaaagauuugcagauuaggcuagcaaauagaauaaaacuguaacuuuguccug

SEQ ID NO: 2250732 - RNA, 82 nt, Homo sapiens
guagaguauguaagugguucuuuaaguauuaaacaauugguucauauuugaauacuucguucaaagauaacuucaggcucac

SEQ ID NO: 2250733 - RNA, 63 nt, Homo sapiens
uuggacguggaggacagacacucuguagguuugaacaucucagaguacuuuucccacuuccaa

SEQ ID NO: 2250734 - RNA, 95 nt, Homo sapiens
gcagugaucgugccauugcauugauugugccauugcgcuaaucaauaauauugauuagugacuggcuacacgguguggaggauagugucagaugc

SEQ ID NO: 2250735 - RNA, 87 nt, Homo sapiens
ggagucuugcucuguugcuuaggcuggagugcaguggcgagaucuuggcucacugcaaccuccgccucccgguucaagcgauucucc

SEQ ID NO: 2250736 - RNA, 59 nt, Homo sapiens
cugcuuagcugagguggcacuuagguugaagcauuaugagacauuggaaaguuaggcag

SEQ ID NO: 2250737 - RNA, 98 nt, Homo sapiens
aguaagugcucgaagagugugaaucauuauuaaauuacucccccaaaucauuuuggaaguuaaauuaguugaugaaaucuaaucuuggagucacugcu

SEQ ID NO: 2250738 - RNA, 74 nt, Homo sapiens
ggguagauuucuguguuuaggucacggcuauauccugaggaccuggaauagugacugacacagaguagaugcuc

SEQ ID NO: 2250739 - RNA, 79 nt, Homo sapiens
gaagcucagagaagggugugauuugccugagaccacacagccgguaacaggcaaggucacaccuugaacccgugucuuc

SEQ ID NO: 2250740 - RNA, 59 nt, Homo sapiens
gaaggaaaguuuauagagauucaucuuccuagaaacaugucccuaagagccuuuccuuc

SEQ ID NO: 2250741 - RNA, 65 nt, Homo sapiens
aggcgaaugauguugggcaccuuuucuagugcugauuaugaaguguguguucaagucuuuugccu

SEQ ID NO: 2250742 - RNA, 60 nt, Homo sapiens
acugugugucacugaggguuaguguaugaaugaucccgucacccaguuagugagcauagu

SEQ ID NO: 2250743 - RNA, 65 nt, Homo sapiens
uagccagggccaccacauacagccaauauucuagucugguuuucugcagugugguugcccugcug

SEQ ID NO: 2250744 - RNA, 94 nt, Homo sapiens
ugagaaucgcuugaauuuggcaggcaaaguuuacagugagccgagauggcaccauugcacuccagccugcacgacacagcgagacaccaucuca

SEQ ID NO: 2250745 - RNA, 63 nt, Homo sapiens
augccagugcauggaucccaggggguugagccacuugaucccuggaucccauggaucuggcau

SEQ ID NO: 2250746 - RNA, 67 nt, Homo sapiens
aagugggaggaucucuugaggccaggaguucaagacgagccuuggcaacauagugagacccccauuu

SEQ ID NO: 2250747 - RNA, 57 nt, Homo sapiens
guugugaacacagaggcuauggcacggcuucccgugcaagcuucaugguuuacugac

SEQ ID NO: 2250748 - RNA, 69 nt, Homo sapiens
aaacucauuuuaguagguaaagaucuucaucuguugggucucaaggcugaugagaucuuuacuggguuu

SEQ ID NO: 2250749 - RNA, 96 nt, Homo sapiens
uugguaguguguccaaauauugguuaaauauuaugugaguauuuacucaggcucuauuuacauaggucuaauguuuuucaaggauuucacugccaa

SEQ ID NO: 2250750 - RNA, 66 nt, Homo sapiens
auuuuucuuuaauuuaugagaugaaaaaucacaacauaugugaugaaucucugggcaaaggaaaau

SEQ ID NO: 2250751 - RNA, 112 nt, Homo sapiens
gaagugguacaguuucauggccaguaugcuuauaaacauuugucagagaaauugagcacaccucaggaaauguuuaguggguugaaugcccagggaagcuguuaaacauuuu

SEQ ID NO: 2250752 - RNA, 105 nt, Homo sapiens
cccccaagucuuuuuacugauacaaaauauuuuacauguuuauggggguacauguauuuuuuauguacauaaaauguauaaugacugagucagagccuuuggggg

SEQ ID NO: 2250753 - RNA, 65 nt, Homo sapiens
gccucuagcucccaggcuuaggugauccucccaccucaaucuccugaguagcuagaacuaggggc

SEQ ID NO: 2250754 - RNA, 88 nt, Homo sapiens
ggagaaucacuugaacccaggagguggaggcugcagugagccaagaucacgucauugcacuccagccugggugacagaguaagacucc

SEQ ID NO: 2250755 - RNA, 97 nt, Homo sapiens
cagggucacaaugcuagggcgcaagaccguccuucacuuaugggccugaaucauaggugcaauggugguuuugugguccuucagcuaaggacacuug

SEQ ID NO: 2250756 - RNA, 79 nt, Homo sapiens
aggcuggagugcaauggcaugaucuuggcucgcugcaaccuccagcucccggguuuaagcuauuguccugccucagccu

SEQ ID NO: 2250757 - RNA, 79 nt, Homo sapiens
gaaaaguaauggccaguuuuuaauugggucugauuaaaaaaauagagacaauccagugauuggauaccuuuuacuuuuu

SEQ ID NO: 2250758 - RNA, 82 nt, Homo sapiens
ugggucaacugguauuucuaguucaagauccuugaggaaucgccacagucuuccacaaugguugaacuaguuuacaguccca

SEQ ID NO: 2250759 - RNA, 69 nt, Homo sapiens
ggcuaaauuuaucucaaacugcagugauucucuuggaacugggaaguuaguguugugauaaauccagcc

SEQ ID NO: 2250760 - RNA, 63 nt, Homo sapiens
cucaucugugaaaggguuagauaagauucagugagauaaugugugacucuggcacauggugag

SEQ ID NO: 2250761 - RNA, 112 nt, Homo sapiens
caguaucacauaggaguguacacccucugcgauauuggaaguaauaucauccucuccccuccuggacaguaagaacaauaucacaguuggguguacaccuccuaugauauug

SEQ ID NO: 2250762 - RNA, 59 nt, Homo sapiens
ugagauggaguuucgcuuuugucgcccaggcuggagugcaauggcacgaucucuacuca

SEQ ID NO: 2250763 - RNA, 59 nt, Homo sapiens
uguguuauguauauuugagugugugauauauaucacaugugacauauauauuugauaua

SEQ ID NO: 2250764 - RNA, 64 nt, Homo sapiens
ggucuuuguugucuuucguauggaacacuacaaguugguccuuuccauuggagacacucagacc

SEQ ID NO: 2250765 - RNA, 65 nt, Homo sapiens
gcuacagaauauuucugcccugagcucauuaugaacagaguuuuggacugacuugucuuuguggc

SEQ ID NO: 2250766 - RNA, 77 nt, Homo sapiens
cacuuuucccaagucaggucaugauaagacucaauguuaauuauugacuucauuuuuggccaugaggggagguagug

SEQ ID NO: 2250767 - RNA, 80 nt, Homo sapiens
ggggcugauccuguagagaugaggguggacacgucagauuuacucaugcaucucagcccagucuuugcaagaacaguucc

SEQ ID NO: 2250768 - RNA, 78 nt, Homo sapiens
ccacccggcuugggcagcauccaugugcuuccucucccguggcacauaagcaggugucugugucuguaaaccgggugg

SEQ ID NO: 2250769 - RNA, 73 nt, Homo sapiens
gcuaauuaguaaccuaauuccaucuguaaugucugaucacaucagcaccuggauuaguguuugacugaauagc

SEQ ID NO: 2250770 - RNA, 81 nt, Homo sapiens
uacauucaaaggugagguugaaggacauuuuuauugauacuaauauaugaauaaaacccaaucaacuucaaguaaaaugug

SEQ ID NO: 2250771 - RNA, 57 nt, Homo sapiens
ugaucugaaugcaucugguaguuuugcagaagccucaaucagaugcauuagggguua

SEQ ID NO: 2250772 - RNA, 64 nt, Homo sapiens
acuugggucuggaaggucgaugcugcagugagccaugauugcgccauugcauuccagccugggu

SEQ ID NO: 2250773 - RNA, 77 nt, Homo sapiens
cccuuagcacagugcgugguacauaauuagugcucaauaaauguuagcucuuguuaguauuagcaguugugcagggg

SEQ ID NO: 2250774 - RNA, 71 nt, Homo sapiens
ucuuuauagcagugugaaaauugacugauauaggaauucuguaccagacgaguggagcacugcuauaaaga

SEQ ID NO: 2250775 - RNA, 80 nt, Homo sapiens
gugguaaaugcagaugcaugaccuuuaagcaacuugcuuuuucuguuguugcccauuaaggaugcuaucauuauuuaccc

SEQ ID NO: 2250776 - RNA, 73 nt, Homo sapiens
cucuugaacccaggaaguggagguugcagugagcugagauagcaacacugcacuccagccugggcaacaagag

SEQ ID NO: 2250777 - RNA, 124 nt, Homo sapiens
caucauaucuugucaccauguaaauccaaguucuucauuaaaaaugugcgugcugugccucaugcuacuucacauggcagcacaauuuucugauggagucuccuuauggugagugccugugaug

SEQ ID NO: 2250778 - RNA, 83 nt, Homo sapiens
agaaaaucucagccaagugagguucaaguugguggaaaagaacccuuuucuguuaauaccgucacauggcugaaguguuuuuu

SEQ ID NO: 2250779 - RNA, 129 nt, Homo sapiens
cuggaacaaguacagaaaggaaaccacuucuucugcuguuaaugcagaucauguuuuuuugacaaauagaucacuggagagagauugagacaaauuuguaugcagaaggaccuuuaugucuuguuuugg

SEQ ID NO: 2250780 - RNA, 88 nt, Homo sapiens
ggaauuugaggucugguaaauguuaacaagacagcacuucauccuaaugaaaguaucuuggaguuugacaaccaacacuucagauuuc

SEQ ID NO: 2250781 - RNA, 75 nt, Homo sapiens
guuuuggcacucagauagagaauaucguagcuuaguauguucucacugcauaaucaucucucugcaugcaugagc

SEQ ID NO: 2250782 - RNA, 129 nt, Homo sapiens
gagaaaacugaggcacaggaaagaaaguaccuuauccaagaucauacagcuaguaaguguaagagauccaucgucuccuguacuuucuaaguuguuucaucaguuagguuccuucucucuuauuuucuu

SEQ ID NO: 2250783 - RNA, 61 nt, Homo sapiens
gugcagaauaaggucaguacaucaucacacagcuuuccuggucucugaccucauuguguac

SEQ ID NO: 2250784 - RNA, 62 nt, Homo sapiens
ggugaauuguaccccauaggaucaucaauaagccacuuagauccacaauagggaaauucacc

SEQ ID NO: 2250785 - RNA, 102 nt, Homo sapiens
cccagaggauucuaaugugcacccaggguugagacccacugacuugaucaaugcuccugguuaaugcuuuuuacacuuuggugugcuggaggaucaccuggg

SEQ ID NO: 2250786 - RNA, 83 nt, Homo sapiens
gcaguuucucauuaagcuacuuagaaggugcucaccuuucuuucgggcacuguuuaucuaagucuugaaagagacccuuuugc

SEQ ID NO: 2250787 - RNA, 77 nt, Homo sapiens
augguauuucuaguucuagaucccugaggaaucgccacacugacuuccacagugguugaacuaguuuacagugccau

SEQ ID NO: 2250788 - RNA, 66 nt, Homo sapiens
aacagaugagguaggccugcuuugaagaaguucccaaagauguucaaauuagucauuuuaucuguu

SEQ ID NO: 2250789 - RNA, 92 nt, Homo sapiens
caggguuaguauacaugaaaaacaagugcgugcuucguggggaauguauggagaaauuucuacguaucagucguuucugugaacaagcucug

SEQ ID NO: 2250790 - RNA, 89 nt, Homo sapiens
gggggauggggcagcaggaggggcugggagagacaggacagccuggggagguuccugugacccccaagcccacucugcccuugcccccc

SEQ ID NO: 2250791 - RNA, 55 nt, Homo sapiens
cuaguucuagaucccugaggaaucgccacacugacuuccacagugguugaacuag

SEQ ID NO: 2250792 - RNA, 79 nt, Homo sapiens
cuccaaugaugccuccaaugauuggagaugaauuucguuuuuuuugagacugagucugucucugucacccaggcuggag

SEQ ID NO: 2250793 - RNA, 119 nt, Homo sapiens
ucugcagcaggagcuugggcccucagagguuuauaaacuggauggugaguuuagaaucuccacugauaucccaguucagccucugacacaugaagcaccauaggcccugcuaacccaga

SEQ ID NO: 2250794 - RNA, 82 nt, Homo sapiens
uucuucagaaggcuuuuggaaauaagaaagucucauuaauaacaauuuaggcugguauuuacaaaagcucucuuguuaggaa

SEQ ID NO: 2250795 - RNA, 73 nt, Homo sapiens
ucauuggguuauuagcgugagguagaaucuaggucuauuuaguucucacuggugcugguaaguuuuacaauga

SEQ ID NO: 2250796 - RNA, 73 nt, Homo sapiens
guccucuggugcccuaguccgggggcggcgagucagagguucucccgugucuuggucuagggccuggcaggac

SEQ ID NO: 2250797 - RNA, 79 nt, Homo sapiens
aaaccuuaucagucuguuggaauaucgcugcaaaaccauguuuugaacggguguguucugucagacugauuggagguuu

SEQ ID NO: 2250798 - RNA, 63 nt, Homo sapiens
aggugguuuuucaacacacacugcccacccucuuguagaucccagugucuguugaucccaucu

SEQ ID NO: 2250799 - RNA, 58 nt, Homo sapiens
gacaauguuguuuuagauggaauuuacuacauagugaauucuguccaaaauaacuguc

SEQ ID NO: 2250800 - RNA, 84 nt, Homo sapiens
cagcuuggcuacugaccugcuagggggucucuuaaccucuugguucacccucuuaaccucuuggagcgucagugcccucagcug

SEQ ID NO: 2250801 - RNA, 65 nt, Homo sapiens
aagugcaaauucccaggcucuggcccaagacagucugacuggguggagccugggagucuggauuu

SEQ ID NO: 2250802 - RNA, 62 nt, Homo sapiens
cucuuuugaugauuacguauuucuucuuccacuacugauaguguauguaguugucaagggag

SEQ ID NO: 2250803 - RNA, 77 nt, Homo sapiens
agggaucucauuaaaugcagauucugcuuagguuacucugggguggggccugagguucugcauuuugacagcucccu

SEQ ID NO: 2250804 - RNA, 92 nt, Homo sapiens
ucauuuuuuauuuaaauaugugauaguuuaagcaguagugccuaagauaaugcucuacucaguagacacucauaugugugauuauuggauga

SEQ ID NO: 2250805 - RNA, 77 nt, Homo sapiens
uucauuuaauaaaguucugcuggcauauaugauguuucucuaaauugguugcuacuuaggagcuuuauucuaaugga

SEQ ID NO: 2250806 - RNA, 55 nt, Homo sapiens
guaagauugcaccuuaaugaacccaucuucgggguaauuugagaguauaucuuac

SEQ ID NO: 2250807 - RNA, 82 nt, Homo sapiens
caggcuaauugucauacauuugcaugcuaaaagacacucccaccagugccauggcaguuuacaaaugccaugacagugccug

SEQ ID NO: 2250808 - RNA, 56 nt, Homo sapiens
ugcagugcaugacuguguuauguuaaaucaacacaacaggguaaucugcaguugua

SEQ ID NO: 2250809 - RNA, 58 nt, Homo sapiens
caaguucauaaguucucaucauuuaguucccauuauaagugagaacaugugguauuug

SEQ ID NO: 2250810 - RNA, 128 nt, Homo sapiens
auuagcugggugugguggcaggugccuguaaucucagcuacuugguuggcugaggcagagagcgauccucacaucucaaccucccaaguagcugggauuauaggcacgugccaccaugccuggcuaau

SEQ ID NO: 2250811 - RNA, 61 nt, Homo sapiens
aucucaguuaauuccaucuuuccagcuacacaugcuagaauccuuggaguuauacuuggau

SEQ ID NO: 2250812 - RNA, 82 nt, Homo sapiens
aaggcaccuagcccagugcuccuggaucauaucacaggcacuuuaucacuugucaguugaauccaagcauuggguuggccuu

SEQ ID NO: 2250813 - RNA, 104 nt, Homo sapiens
cuugaggcacuguagugaaacuuugucauuaguaacgacuuuugucuaacacagauuaaccaaucaagagucaaaugcuuauguauaaagcacacugcuuuaag

SEQ ID NO: 2250814 - RNA, 57 nt, Homo sapiens
agcuucuccaucagcaccugcugcuucaccuugcacuuuuauguuauggagacagcu

SEQ ID NO: 2250815 - RNA, 84 nt, Homo sapiens
ggaucuugcugugucacccaggcuggagugcaguggcgcuaucaugguucacuguagccucagccucuugggcucaagcaaucc

SEQ ID NO: 2250816 - RNA, 78 nt, Homo sapiens
ugucaugcccaguuacuucagucacauuguguucauuacagacacaaccuaauccuaugugacugauguaaucagaca

SEQ ID NO: 2250817 - RNA, 129 nt, Homo sapiens
ggagucacugugucuaaaacuaauacuaagauaaagaugguggaaggucaugaauguucuuuuucuaaauaaagaccuguuuuugaucuccacccuuggacuuuuccaguuuuguuuucauagcucuuc

SEQ ID NO: 2250818 - RNA, 72 nt, Homo sapiens
uuuuuuuugagauggagucucgcucugucuuucagucuggagggcaguggugcgaucuccgcucacuggaag

SEQ ID NO: 2250819 - RNA, 70 nt, Homo sapiens
ugccuaggaucagagugaaccuuguuaugacgcuuucagaugccauguucaacacuuuggucaccaggca

SEQ ID NO: 2250820 - RNA, 62 nt, Homo sapiens
agcugguuaggaagcucucguguauauuuagagacaauuacaagaaagcuggacuugccgcu

SEQ ID NO: 2250821 - RNA, 55 nt, Homo sapiens
uuguuuacuacuacaugcccagcaucuggcauagugccuggcauguaauaagcaa

SEQ ID NO: 2250822 - RNA, 82 nt, Homo sapiens
gaaucaaggaguuggacuaagaacuuaaaauaauucuuccacacugagagugguuuguucuggucuagcaauccucucauuc

SEQ ID NO: 2250823 - RNA, 74 nt, Homo sapiens
gacugauaguugugagaacucuuacucggcuugauacaagcaccuuggaaaggugggacuuacguacuaaaguu

SEQ ID NO: 2250824 - RNA, 59 nt, Homo sapiens
ugagacugaguuuccaucuuguugcccaggcuggaguacaaugaugcgaucucagcuca

SEQ ID NO: 2250825 - RNA, 68 nt, Homo sapiens
ggguaugugcgcacaacgugcagguuuguuacauauguauacacgugccauguuggugugcugcaccc

SEQ ID NO: 2250826 - RNA, 129 nt, Homo sapiens
ccuauucuguaggcugucuguuuacucuguugguaauuucuuuuggugugaagaagcucuuuaguuuaauuagcuucuucacaccaaaagaaauuaccaacagaguaaacagacagccuacagaauggg

SEQ ID NO: 2250827 - RNA, 77 nt, Homo sapiens
uggucuauggccuguaaacuagagacccuggaaagcuggugacauaguuccaguccaaguuugaaggcccaagacca

SEQ ID NO: 2250828 - RNA, 129 nt, Homo sapiens
aacuccugaccucagguaauccacccgccucagccucugaaagugcugggauuggccgggccaguggcucaugccuguaaucccagcacuuugggaggcugaggugggcggaucacgaggucaggaguu

SEQ ID NO: 2250829 - RNA, 93 nt, Homo sapiens
cggggacacagaucuaaaccagaucacauguguacucaauguguagcucccacuuauaagugagaacaugugguguuugauuuucuguuccug

SEQ ID NO: 2250830 - RNA, 72 nt, Homo sapiens
ggcaggauuauuacuccuauuuuguagaugaggaaacucagucauagaaaagugaaguaagcuguccaagcu

SEQ ID NO: 2250831 - RNA, 74 nt, Homo sapiens
auaucagugauggcacugccuggcuucauggcacccugccgugcugcaugaagacaggcugugccuucuggugu

SEQ ID NO: 2250832 - RNA, 129 nt, Homo sapiens
uauguauaucaaauaguuauuccuuuuuauuacugacuagcauuccauuguauaacacaguuuguuuauccauucgccuguugauagacaucugaguuguugccuguuucuggcuguuuuaugaacaug

SEQ ID NO: 2250833 - RNA, 66 nt, Homo sapiens
guggggauuaagugagaguuggguggggcuccuugcuccucuucccaguuaauccuuaaucuccac

SEQ ID NO: 2250834 - RNA, 64 nt, Homo sapiens
aucugacuuuuaauuugaaaacaugaggauuuccccauauuuuuauaaaguggaaguaccagau

SEQ ID NO: 2250835 - RNA, 91 nt, Homo sapiens
uagaauccuuuguuuaucuuugaccuaugggaguuugacuacuaaaugccuugagguagucuccuuuggguuaaaucugguugguauucua

SEQ ID NO: 2250836 - RNA, 60 nt, Homo sapiens
uuaauaggagcaaagagaacgaggucuggaacccaggagauucacugggcucucuguugg

SEQ ID NO: 2250837 - RNA, 67 nt, Homo sapiens
gaggcuucagacagaauagacuguuaauguuucuuaucagacuuagagagucuauucuaucagccuu

SEQ ID NO: 2250838 - RNA, 63 nt, Homo sapiens
gucaaagagcagaaacaacuuguucaagggcagacccugagcaagucauuuuguuaaacugac

SEQ ID NO: 2250839 - RNA, 127 nt, Homo sapiens
ugauaagaaaauaaauguguauuuguuaagcuagugagacagugguacuuuguuauggcagcccuagaaaacaaauacaguagccauucucuuuaucuggcacagaagcaacuuuauuaauauauua

SEQ ID NO: 2250840 - RNA, 64 nt, Homo sapiens
auggggguaaacuccuuuggaauguauuaaauccaacuucauucuauggauaaaaugcccucau

SEQ ID NO: 2250841 - RNA, 75 nt, Homo sapiens
aucaagguguaggcugggaugcauuuucaucaguaggcucaacuagggauggauaugcuuccaacugccuaugau

SEQ ID NO: 2250842 - RNA, 129 nt, Homo sapiens
agaagaaagaguacugacuggaaaucagagaggcaugaagagcuuguucuaccuuugacgcauuccugcuuucugcccgugggcaagucacuucaguucucuggcccucaguuuccugcucuuuaaaau

SEQ ID NO: 2250843 - RNA, 79 nt, Homo sapiens
cugccagugccacacagcugaaagcaaacagagcagcucagcacgcucagacuuuuugcuucacuguuuggcaaaacag

SEQ ID NO: 2250844 - RNA, 76 nt, Homo sapiens
uggggaucuagagcggugcugggggauguuaacugguguucucugguuguaucucacaccccucucauauacccca

SEQ ID NO: 2250845 - RNA, 69 nt, Homo sapiens
guucauucguguauucauucauucacucaaugcguugagugccuacuauguagaugcugcgaauguagc

SEQ ID NO: 2250846 - RNA, 106 nt, Homo sapiens
agauuauuuaaaugcucuucaaguauaguguuuucaaaaguauguuuauaauuuuguacacauaugauguaaauauuuaugcuauuaagugugacaugaauaauuu

SEQ ID NO: 2250847 - RNA, 60 nt, Homo sapiens
cagaauaccacaggcuggguaaucuauaaacaauugaaguuuauuuggcuugugguucug

SEQ ID NO: 2250848 - RNA, 85 nt, Homo sapiens
agaauucagaaauaauucuacugaguguuauuuguucaauaguaauaaaacuguuuguauaggcucaguaagaaucuguccuucu

SEQ ID NO: 2250849 - RNA, 55 nt, Homo sapiens
uuuuguuuggaaugcaguggcugcagacugcacagcucagugcacccccauaaaa

SEQ ID NO: 2250850 - RNA, 71 nt, Homo sapiens
ggcagugguguugccuguugaccuagggcauaccuaagcaucaccugggaagcaguaggcauaccauggcc

SEQ ID NO: 2250851 - RNA, 102 nt, Homo sapiens
ugaggcaggagaaucacuugaaccgcguagguggagguugcggugagccgauauggcaccauugcacuccagccugggcaacaaaagugaaacuccgucuca

SEQ ID NO: 2250852 - RNA, 57 nt, Homo sapiens
uucuugguuggcaaccaacagugucggccucacgacacuuugauucuugaucaagag

SEQ ID NO: 2250853 - RNA, 74 nt, Homo sapiens
ucuguuuaaacgaaauugcucagaagcccuauauguaaaauagguauaaauggagcagcuuugguugaagcaga

SEQ ID NO: 2250854 - RNA, 83 nt, Homo sapiens
caagauaaugaaaguuaaguauuuagcaugaugccuggcaccugacgggugguccaggaauguuaguacuucuuaguguuuug

SEQ ID NO: 2250855 - RNA, 78 nt, Homo sapiens
ucccagccuugagcuaguugcaccagcagggacugcagcuaacagggaccuuugagaguaccuggcccagggcuggga

SEQ ID NO: 2250856 - RNA, 130 nt, Homo sapiens
ugagucuccauuuccagaugggcccucccaggccuagaggaguacuacuccaagucuggcaguaguacucacacuuggaguaguauuccucuaggcccugggggggccccaccuggaaauggggagagaa

SEQ ID NO: 2250857 - RNA, 69 nt, Homo sapiens
uucaguuuccuugagaaaggcacaaguuguuacuucugguaauuuugcuuuuacuuagaguggacugga

SEQ ID NO: 2250858 - RNA, 57 nt, Homo sapiens
uaugguuaggcacauggacuuuggagcuaccuucuccagguucaaaucccaaucaug

SEQ ID NO: 2250859 - RNA, 85 nt, Homo sapiens
uauuaaguuggugcgaaaguaguagcaguuucugccacuuaaaaguaaugguagaaaccacaauuacguuugcaccaaccuaaua

SEQ ID NO: 2250860 - RNA, 66 nt, Homo sapiens
caaugcuuuuuaaagguagccaguaacacacuaagcauacugaacugccuaaagaaaaagacguug

SEQ ID NO: 2250861 - RNA, 84 nt, Homo sapiens
cugcauucccuguccugcugugaggugugaccaccugauggccccauuccaguguguucauccucagagaugucaagaaagcag

SEQ ID NO: 2250862 - RNA, 95 nt, Homo sapiens
ggguguuaaaagucaagauuguauacuuucaaaggucaggguucuuucauaccucagauguuugagaaguauacugaacaugauguuaaacaucu

SEQ ID NO: 2250863 - RNA, 64 nt, Homo sapiens
gacauccacaugcaguuggaaacaggcaguugaacacaccuguuugaagcucaugggugagguc

SEQ ID NO: 2250864 - RNA, 72 nt, Homo sapiens
ccagaccuucagagugaggcucucggaacucacucugaaguuaaaguucuucgccucucuuugaaaguuugg

SEQ ID NO: 2250865 - RNA, 91 nt, Homo sapiens
gauaggauagaugguucugaguggcuuucaacacugacuacuauucucuuuuagccagcagugaguagcuuacucagaauuguccccuauc

SEQ ID NO: 2250866 - RNA, 103 nt, Homo sapiens
ccaugagcaaguacuuccaccucucugagcaucaguggccucaucucagaagacugcugggaagaguaaccaggaugcugggugugaagcuccuagcacaugg

SEQ ID NO: 2250867 - RNA, 81 nt, Homo sapiens
ccaaggauuggggggaugcugugcccagggugccucugagaccugggggcaggcugugcuuggagucccccuaggccuugg

SEQ ID NO: 2250868 - RNA, 68 nt, Homo sapiens
gaaaaugagguuuugcuauaguuaaugcaucucaagauggcauauaauauagaagacuaguaguuuuc

SEQ ID NO: 2250869 - RNA, 111 nt, Homo sapiens
acagucuugauccuauggguucugaaaaguucuuugagccuugacaagcagacguauugguguuaagaagcccagggaauuggcagaggccugaagaugcacagaggcugu

SEQ ID NO: 2250870 - RNA, 56 nt, Homo sapiens
uguuucacuacucagcauggaaacaagaugaaauuccauuuguagguagugagaca

SEQ ID NO: 2250871 - RNA, 57 nt, Homo sapiens
gcauauugguauaggucuauuucugaguuuucuuuucugaucuguugaucaaugugu

SEQ ID NO: 2250872 - RNA, 64 nt, Homo sapiens
guaaucucagcuacuugggaggcugaggcaggagaacugcuugaauccaggaggcagagguugc

SEQ ID NO: 2250873 - RNA, 64 nt, Homo sapiens
agaccaugucguaauuagcugcaaugauaggaaguuaauucauuugguucccucugacaggucu

SEQ ID NO: 2250874 - RNA, 65 nt, Homo sapiens
auugccuggaggagguuugucagccuacacaggcuccuggagaugguuuauacuccccaggcaau

SEQ ID NO: 2250875 - RNA, 68 nt, Homo sapiens
guguuguuuucuaguuagacuucuuuucucuauuacuuuggguuuugaggucaguaagaaugcagcac

SEQ ID NO: 2250876 - RNA, 60 nt, Homo sapiens
uguuuuuuuaagugaaagaaaaggacccuucuggguuuugguaaugaacuuaggaagaca

SEQ ID NO: 2250877 - RNA, 81 nt, Homo sapiens
gcuuugucugguugacagcauguggcccucguaaccaaggggugauucaacccuggccacagggcugaacguggacaaggc

SEQ ID NO: 2250878 - RNA, 62 nt, Homo sapiens
agggaaggcuuuuacuauuuguuaacucacuugagggacauaaacugucaaaagccagcccu

SEQ ID NO: 2250879 - RNA, 90 nt, Homo sapiens
uguuuggaguguggauuuggaggaaggaugguugcuaugaaaagauuucuuuauaaacagcuuauccucuauucucccaacguccaaaua

SEQ ID NO: 2250880 - RNA, 64 nt, Homo sapiens
uucaguuugccaguauuuuauugaggauuuucacauugauguucaucagggauauuggccugaa

SEQ ID NO: 2250881 - RNA, 58 nt, Homo sapiens
gcuuugggauuccuuauuuuuggaugaguggcuuugaaagugaauguaucccguaagu

SEQ ID NO: 2250882 - RNA, 129 nt, Homo sapiens
gacaugugauguguguuggcacauguggccauauguugacacauguagacaucugguguguguguguaugcauaugugucaccauguguggaugugugugauuuguguuggugcaugugggcauauguu

SEQ ID NO: 2250883 - RNA, 56 nt, Homo sapiens
aauuugagagggucaagaucagagugcuaugauuugaauguuuccccucccaaauu

SEQ ID NO: 2250884 - RNA, 75 nt, Homo sapiens
aggaauggagucuucaggggguguaucaucuaaaacaaggaaauaaaaugauucuucacuauggagcucuuucuu

SEQ ID NO: 2250885 - RNA, 59 nt, Homo sapiens
uucagaggcuuggucucagguaucuccaggagagauaccugagaaagaaagcccucgaa

SEQ ID NO: 2250886 - RNA, 94 nt, Homo sapiens
uuaccuauauuuugauguacuguuuaauagauuuauuuccaaaauguaacuuuuuaauuaauuggaauuuauuuggaugggagaggugagguaa

SEQ ID NO: 2250887 - RNA, 55 nt, Homo sapiens
uugagauggagucuugcucucucgcccaggcuggagggcaguggcgcuaucucag

SEQ ID NO: 2250888 - RNA, 117 nt, Homo sapiens
ggugacugucucagcguguuuuucccucauuucauguacagggaaaugcaaaccugcauccuugguuccuuguagcaaaugcgaugaggaaauugcuuaacugaagaaugugucacu

SEQ ID NO: 2250889 - RNA, 64 nt, Homo sapiens
aaggcugaauagcuuugaaauggccauaaauuugcauaauggcuugcauaaagcuaaucacuuu

SEQ ID NO: 2250890 - RNA, 77 nt, Homo sapiens
gaaaccacugggcaguuuauuaucaguaucuugucucccugcuuaucaauuuugaucauaaucuugcucaguguuuc

SEQ ID NO: 2250891 - RNA, 72 nt, Homo sapiens
cuggcugaggcgagucucaguauuaagagcugugcccucgcugcuaagagaaugagacuuagcgcucuccgg

SEQ ID NO: 2250892 - RNA, 73 nt, Homo sapiens
gggacccgagcuccagcugaugucgaaugcacucucuggagaugacgugugccggcgucagccagcauuuccc

SEQ ID NO: 2250893 - RNA, 58 nt, Homo sapiens
gaaucuguacuuggaggccccauacaaccauucugcauuucacuuucaguacagauuc

SEQ ID NO: 2250894 - RNA, 65 nt, Homo sapiens
ugacauuucagacaggaggcuggggaagauauugcaucauugcauuggccccguuuuaaauguca

SEQ ID NO: 2250895 - RNA, 56 nt, Homo sapiens
uggauaguaauaaacauauaggugcagagguaucuuugugguaugauaauugucca

SEQ ID NO: 2250896 - RNA, 65 nt, Homo sapiens
guucauccaugcaguaucaguacuucauuccauuuuaugacggaauaauauugcauuggauggau

SEQ ID NO: 2250897 - RNA, 75 nt, Homo sapiens
gcaauaauugcaucuguucuuugccaggaaauauuuaaauauuguuauugguugaaacaaaaugcaaaccuuugu

SEQ ID NO: 2250898 - RNA, 95 nt, Homo sapiens
uuguuuuuggcucaguuugugugugugugugugugugugugugugugugugcacgugcaugcacacacaugcgcuacaguaucagccgaauguga

SEQ ID NO: 2250899 - RNA, 58 nt, Homo sapiens
aucugguguuuccuucacauugucccucuaccuggagugaguguggggaacacaggau

SEQ ID NO: 2250900 - RNA, 59 nt, Homo sapiens
uggaguguaauuagccaucagucucucuucuccuuggacugaaauggccucucgcucua

SEQ ID NO: 2250901 - RNA, 88 nt, Homo sapiens
gaauaugugaguauauacaugugugagcgaagaugugagcacguaagcauaugugagugucucaauauguguguaaguucauauguuu

SEQ ID NO: 2250902 - RNA, 58 nt, Homo sapiens
ucagacgcucacuuucugcacacauagaaggauuugugugaggaguuacuggcuuuga

SEQ ID NO: 2250903 - RNA, 63 nt, Homo sapiens
uggcgauuguuaugagaaguaacugagcuaguauuuucucagcaaucucacagcaaucuguca

SEQ ID NO: 2250904 - RNA, 78 nt, Homo sapiens
cugagguuuuagguuucuggauuuauuauggcacccaguagcaaagcuggagucaaguguuuucaaggcuuccauuag

SEQ ID NO: 2250905 - RNA, 62 nt, Homo sapiens
ggagagccaggaacaucagucugaggaaugugagaaaccuaggcuuuuggagguggcuuucu

SEQ ID NO: 2250906 - RNA, 58 nt, Homo sapiens
aaguuucucuauuuuauaagcagcucucucuacaugcagugcuuauccagagaaacuu

SEQ ID NO: 2250907 - RNA, 76 nt, Homo sapiens
caugcacaggcacacaucauuuauugaaucuuguuaaaaaggcaugauguaaacagaugugcagcuuguccccaug

SEQ ID NO: 2250908 - RNA, 101 nt, Homo sapiens
gguaacaaucaucugaguuuucagcaagucauaaucuuuuugcuacuggauggccuugccuugauauuguuggcugcuggcugauagaggugguuguugcu

SEQ ID NO: 2250909 - RNA, 65 nt, Homo sapiens
ugggggaagugugugcauaggauggagcuauguuucuagaaccagcauggauacauuuucugcua

SEQ ID NO: 2250910 - RNA, 89 nt, Homo sapiens
uaaguaucaguuuagcuaugauagauuagguuagauuacucagaaaaaaugccucaaaagcuucuaagucauaauugaucugauacuug

SEQ ID NO: 2250911 - RNA, 66 nt, Homo sapiens
auguugguagguuguauguguuuagggauuuuuccauuucuccuagauuauccaacuuauuagcau

SEQ ID NO: 2250912 - RNA, 88 nt, Homo sapiens
ggagaauugcuugaacacgggaggcagagguugcagugagcugaggucccgccacugcacuccagccucggugacagagcaagacucu

SEQ ID NO: 2250913 - RNA, 58 nt, Homo sapiens
agauaugccugcauguggaaccaauguauauuuacggugauccauugcagcauuauuu

SEQ ID NO: 2250914 - RNA, 66 nt, Homo sapiens
cuuaggcucuuugaggugcccaguguccuacuaauaaauucucuucauuguuuaaaguagccuaag

SEQ ID NO: 2250915 - RNA, 75 nt, Homo sapiens
ucuuagagcaucagguaggccaauguuuuccaaaaggcgcuuuucaggacauuagucugcugagaugugcugaga

SEQ ID NO: 2250916 - RNA, 98 nt, Homo sapiens
gggaauaaacauggagcucaucuagcauagagguuggcaaacuuucugucaagaaucagauaguacauauuuuuggcuuugugggcucuaugguuccc

SEQ ID NO: 2250917 - RNA, 100 nt, Homo sapiens
gagggaaagaaggguauuuucuaugcauuuuggaggagggaauucuggugagcuucuguuuuagaaaaguguuauggaggcaacccuggcaaacucccuc

SEQ ID NO: 2250918 - RNA, 67 nt, Homo sapiens
gcaaacugugugagaauucacagaaauaaaccugguagguuugugcuauguuauucacaugggcugu

SEQ ID NO: 2250919 - RNA, 93 nt, Homo sapiens
acaugucauuaugcacuggucaaacccauagaacauacaaaaccaagagugaauugucaugucaacuauggaauuugggugaugaugaugugu

SEQ ID NO: 2250920 - RNA, 64 nt, Homo sapiens
uggcugcuguacagguuccauuugaaugcccugauagaggacuauggcaccugacagauagcca

SEQ ID NO: 2250921 - RNA, 64 nt, Homo sapiens
gacuccauuuggacucugggaggauccuggccccaaaccacccucccaagaaccuccaugaguu

SEQ ID NO: 2250922 - RNA, 89 nt, Homo sapiens
guauguguauuguuguaucuaccugcagauauguaugucuuauuguaucuacauguagguauguauguauacuuuuaauguacacauau

SEQ ID NO: 2250923 - RNA, 77 nt, Homo sapiens
gaugcucacaagaaguugcaccguacucauggcugagcagaucaaggcuagagaauagugccacuaaaaugggcauc

SEQ ID NO: 2250924 - RNA, 129 nt, Homo sapiens
uuggccucccaaagugcuggaacuauaggcgugagccacagcacccggcccaaaauggaaucuuaaaaauaaauaccacggccagaugcaguggcucacaccuguaauuccagcacuuugagaggcuga

SEQ ID NO: 2250925 - RNA, 121 nt, Homo sapiens
gaaugucaguuugugcugucagucuuuuugauguagauauuuuagggcuaugaacuuuccucuuagcaccaccguugcucuaucccagggguuuugauagguugugucacuauugucauuc

SEQ ID NO: 2250926 - RNA, 65 nt, Homo sapiens
cagaagcuggugccccgggggcaguuggacagcccauggacauccccgggagcaccagcuuguug

SEQ ID NO: 2250927 - RNA, 57 nt, Homo sapiens
aaagggaagcuccuuuugagcauguacucauucuuguucacuggucuauuucccuuu

SEQ ID NO: 2250928 - RNA, 59 nt, Homo sapiens
gggagcuuggaggcccggcugguuuuucuaaggaguuggccggguggccauggcugccc

SEQ ID NO: 2250929 - RNA, 66 nt, Homo sapiens
gcauaugauaggguuuccagggcugucaccauuuuagucaucuucccuggacauucaucauuaugu

SEQ ID NO: 2250930 - RNA, 93 nt, Homo sapiens
gucaacaucaucaaugccgaucuugaaucuucugcuuugaacuugaagugggaccacaacuuagacaagauggcuugagguucaacaguugau

SEQ ID NO: 2250931 - RNA, 64 nt, Homo sapiens
uuuagauagaugguuuuguucacagcucuuucuccuggcagggcuguucauaaaugauccugaa

SEQ ID NO: 2250932 - RNA, 101 nt, Homo sapiens
gcccuacuacagacaaaaaucacuguguccuuuguguaucuauaguaguuugaauuuccagauacagugcauagaggcaugauacuuuggucuucuggggc

SEQ ID NO: 2250933 - RNA, 71 nt, Homo sapiens
uauacauguaauugauuuuguguuagccagucaugucauguuugacuaacacugaaaaugaugcaugugua

SEQ ID NO: 2250934 - RNA, 58 nt, Homo sapiens
ugagacggagucucgcucugucgcccaggccggagugcaguggcgcgaucuccgcuca

SEQ ID NO: 2250935 - RNA, 130 nt, Homo sapiens
cucucaagccuggagcaugcuuugguggaauucagugcaguguuugcauggaaucauaacaaggucuguauuugauuuucagccaauauugacugaagucccacagagcgcucucagaccugaauuaggg

SEQ ID NO: 2250936 - RNA, 75 nt, Homo sapiens
gggcaacaugguaugacccugucucuauaaaaaaauuugaaauuagccaggcaugguggcacauacauguagccc

SEQ ID NO: 2250937 - RNA, 73 nt, Homo sapiens
uaguuuggugcauaaguaauugcagcaauuugccaauaauggcaaaacccgcaauuacuuuugcacuagccua

SEQ ID NO: 2250938 - RNA, 68 nt, Homo sapiens
guaccuuaagcuaagugaaauaagucagucacgaaagaauacugugugauuccacuuguuugagguac

SEQ ID NO: 2250939 - RNA, 116 nt, Homo sapiens
acaaauauuguuuucugguuguaaauaucagauccuaaaugacagaaauucaguaccuagcacaguacucagagagaacugucauuuggccucuggagccagagagagucuguugu

SEQ ID NO: 2250940 - RNA, 60 nt, Homo sapiens
cacuuuauaaccugagcuuaugauuaugauuaccugugaaugguucaguuuauaaagaug

SEQ ID NO: 2250941 - RNA, 102 nt, Homo sapiens
auuuuuguuccauauagagcauuauuauauaaucccucaugucccaggccuuagccugagaugugugugauuauauaauagucuuuuacuccuugaagaagu

SEQ ID NO: 2250942 - RNA, 59 nt, Homo sapiens
accucaggcugaaauucaggcauuuggagcaucauuugccuagaccaucagccugaggu

SEQ ID NO: 2250943 - RNA, 98 nt, Homo sapiens
gcaguggcccagcccugcaaggccccagauggugucccaggcucaggcugugcagucgcagucggggccuggaggcaccaggccuugcaggccacugc

SEQ ID NO: 2250944 - RNA, 77 nt, Homo sapiens
gcuguuuccucacugcuaacuuuuauugacuuugucaaagaucagauggcuguugguguguggguuuauuucucagc

SEQ ID NO: 2250945 - RNA, 99 nt, Homo sapiens
ccagugugcguguugcuaauuguauggcaggaggcacacggcaugcucugugugcucaucacaugcaauaggacaacauauugagccacagugcauugg

SEQ ID NO: 2250946 - RNA, 66 nt, Homo sapiens
cagagagcuuuugguugcccuaaugauagggaugggggagucauuacggugugggguaguuuuuug

SEQ ID NO: 2250947 - RNA, 70 nt, Homo sapiens
aucguuugaaccugggaggcagagguugcaguuagccaaaauugcacuacugcacucccaccugggcgau

SEQ ID NO: 2250948 - RNA, 57 nt, Homo sapiens
gcccaggauuggaggcuguggugaauugagauugcaucacaguacuccagccugggc

SEQ ID NO: 2250949 - RNA, 94 nt, Homo sapiens
ggauaagcuguugauagugguuguuggaguggcaauuuccaaaguuuuggagauuugugaaaccuaguaauucuauuuuauaacaagcuuaucc

SEQ ID NO: 2250950 - RNA, 67 nt, Homo sapiens
ugcucccaucuucuuucugcaaaguccccaaaacaagauguuugguguacaaaacaagaugggggua

SEQ ID NO: 2250951 - RNA, 82 nt, Homo sapiens
gguuaucaagcagugcauaggaucuaaaauuugauuuccuuaaguucaaauucuggaucuaugacuuauuagcuggguggcc

SEQ ID NO: 2250952 - RNA, 76 nt, Homo sapiens
uuuuuucuauaucgauuucauugccucugaggucuguacuucucucuguccugggaugaaguugauguagaaagaa

SEQ ID NO: 2250953 - RNA, 65 nt, Homo sapiens
cacuuccugaaauggauuuggugauacuucucauugaggugucaugaacucacauucugggggug

SEQ ID NO: 2250954 - RNA, 72 nt, Homo sapiens
ggguuuucuuagagcacugaucugcucuuuaacaaaaauuuguaaaggguuauaaaggguuuaugagaaucu

SEQ ID NO: 2250955 - RNA, 69 nt, Homo sapiens
ugggucuggggagccuguuccugggcagcagcaucucucccacugcuggaguaggcuguccggcaccca

SEQ ID NO: 2250956 - RNA, 123 nt, Homo sapiens
auagugaaaugacuaugccaaagaugaaggaacuguaaagaaauucuaaggaagugaaugggucuuacauggccuuaugguacucuuugcagagaucaauauuuuaaaaaauuauuuuauuau

SEQ ID NO: 2250957 - RNA, 68 nt, Homo sapiens
gagguggguggaucaccugaggucaggaguucgagaccagccuugccaacauggugaacucccaucuc

SEQ ID NO: 2250958 - RNA, 60 nt, Homo sapiens
uugagacugagucucgcccugucguccaggcugcacugcaguggcgugaucucagcucag

SEQ ID NO: 2250959 - RNA, 90 nt, Homo sapiens
uccuggucucugaauaggcucuccugcugucucuggucugcccaucccacucaccccugagacuugagggggcuucucugagagccagga

SEQ ID NO: 2250960 - RNA, 84 nt, Homo sapiens
aagaaagaaagaagccuguuuucaacagaacuagagccuauagaaauuuucauauuccacucuguuggagguaauuucuuucuu

SEQ ID NO: 2250961 - RNA, 78 nt, Homo sapiens
ggagaaaagcccccaugauucaauuaucucccacugggucccucccaugacagguuggaauuaugggagcugcaauuu

SEQ ID NO: 2250962 - RNA, 73 nt, Homo sapiens
aagccugaguccuuuggccauagcuaaaugauuucauucuuuucaaaucaucuagguugagccaaucaggcuu

SEQ ID NO: 2250963 - RNA, 100 nt, Homo sapiens
gauugucauggagagccuggugcuaggaguuuggacuuuauccauuauggaauggggaggucauuguaaggucuuaaaccaggcagggacauggucaguu

SEQ ID NO: 2250964 - RNA, 65 nt, Homo sapiens
gaaaguuuagauuuuguugcaccacaguuauuuuaauggcuguaauguaaugagacuacauuuuu

SEQ ID NO: 2250965 - RNA, 127 nt, Homo sapiens
ucacagagccucuuaacacuuccaccugaaggugacucaaguugcuccugcucaugguucauuggacaaaaaggaucacagagucacgggcaacuucucuguuucuggaaggggaaccaaaauguga

SEQ ID NO: 2250966 - RNA, 93 nt, Homo sapiens
gucagguagaguguucuguagauauuuguuaggucugucaggucaagugucacauugaggucccaaauaucuuuguuaauauucucccuugau

SEQ ID NO: 2250967 - RNA, 75 nt, Homo sapiens
cauggagguagugagcagcugaacuagaaauggaaccaaaugcccugguucuaguccucgacccuaaccuucaug

SEQ ID NO: 2250968 - RNA, 64 nt, Homo sapiens
uugcuugaugauuaauguuaaaugugagaguugggggcucuaaaauuuggcauaguuuaagcaa

SEQ ID NO: 2250969 - RNA, 115 nt, Homo sapiens
uguuuaacaaacuaccuuuguaaauaauuucuuuucucuaagaauugaauuuaauaauggaauaugaaaugcugucuaggggaaaugagaaugagagggaguuuuaauuugaaua

SEQ ID NO: 2250970 - RNA, 75 nt, Homo sapiens
cacuaucuagcacauaguuauucacucaacauguauuuauugacucauugaugugaaauuguguuggcuaaagug

SEQ ID NO: 2250971 - RNA, 63 nt, Homo sapiens
uuagugcccuuauaagagcaggaaaagagaccagaccucuuucugucucagugaggacacuga

SEQ ID NO: 2250972 - RNA, 55 nt, Homo sapiens
ucuuuggucuacuuucauauguuauguuuucugaacaugagaguagaaauaagga

SEQ ID NO: 2250973 - RNA, 63 nt, Homo sapiens
uguuguuuaagacacccauucuauggcauauuguuaugacagauggaguugacuaagacaaca

SEQ ID NO: 2250974 - RNA, 62 nt, Homo sapiens
ggaaaggaaaaccagcauuugcucaggcagccucucugggaagaugcugcuucuuccucucc

SEQ ID NO: 2250975 - RNA, 58 nt, Homo sapiens
uguuuuuaaaccaguccauuaacaauacauuuggaaauauggaccuggauuaacagca

SEQ ID NO: 2250976 - RNA, 92 nt, Homo sapiens
uuaaacaguauaggucagaucauauucuucgcugcuuaaaacuuucuaauguguuucuauagcgcuuagaauaagaucugaauugcuuuuga

SEQ ID NO: 2250977 - RNA, 85 nt, Homo sapiens
cauccagcuacacguucuuucaccaucaucacccuccaguauugagugugagguacgugucaagaaccacacagcuuuucggaug

SEQ ID NO: 2250978 - RNA, 70 nt, Homo sapiens
uuuuuaauggcuugugggaacuuuuaaacccugauauaaucuguguagcugucucacuagccaucaaaaa

SEQ ID NO: 2250979 - RNA, 69 nt, Homo sapiens
cuccacggcucacugggaccacucugaaguuggcugacguucaacuuuucccuggggugggucuuggag

SEQ ID NO: 2250980 - RNA, 58 nt, Homo sapiens
ugauagugcuuauccaggagaacugacaggacaguuuugagugugauaaacacuguca

SEQ ID NO: 2250981 - RNA, 74 nt, Homo sapiens
gcuuagagcaccauuagcguugggccggugccacagagcaaauaggacugagccccaucugaggugcccagagu

SEQ ID NO: 2250982 - RNA, 76 nt, Homo sapiens
ccauuauugcaaagcguagacucuaaacauauuauuagcaucaaaaaauguuuguuuuguaucuuuguauuaaugg

SEQ ID NO: 2250983 - RNA, 117 nt, Homo sapiens
uuauaguuuuuagaaguuaugcuuauuucauuaaggaguggguucauggugcuaucccagaaguagcaccugauagcugccuccuuaucuuaaaaagcaaacuuacauuugcuguag

SEQ ID NO: 2250984 - RNA, 80 nt, Homo sapiens
augcuagaccugggcaaaacuaagagcuguggguaaauuuaccuaugggccucagaaguuuuguacacaggcaucugcau

SEQ ID NO: 2250985 - RNA, 71 nt, Homo sapiens
ggucucugguuuuccuagggagaggacccugcggccuuccgcaguguuugugucccuggguacuugagauu

SEQ ID NO: 2250986 - RNA, 77 nt, Homo sapiens
ggacuccuuuggcacuguugccggccugaauuggacccccaauucugccacuccagcaguaguagccaaauuaguuu

SEQ ID NO: 2250987 - RNA, 125 nt, Homo sapiens
ggaggagccuaugggggagguaauugaaucaugugggcagacuuccccccugcuguucuggugguggaguucucacaagaucugguuguuuaaaaguguguagcacuucccccuuugcucucucu

SEQ ID NO: 2250988 - RNA, 68 nt, Homo sapiens
agaugcagaaacugccagucgauauuugaacaagguuacccacaagagcugguaguuuucuaguguuu

SEQ ID NO: 2250989 - RNA, 73 nt, Homo sapiens
caaguuauaguagcaugcacuggugcugggggcagaaaauguccauagacaccaaguaaugcuauucuauuug

SEQ ID NO: 2250990 - RNA, 62 nt, Homo sapiens
ccccaaaggggaugcucagugcaggggugaacacagccugcacugagacccucuuugcuggg

SEQ ID NO: 2250991 - RNA, 76 nt, Homo sapiens
agagcuuuaaaaauaggaaaauauuuaacaagauaauacuuauuuuuagucugugaaaucauuuccuguaagcucu

SEQ ID NO: 2250992 - RNA, 103 nt, Homo sapiens
agaauuuuccuuagacaagcuuccugcucacuacauuccaaccuuguuucuccccuaccagguuugaauguaaugagcaggaagcccgucuaaggaaaauucu

SEQ ID NO: 2250993 - RNA, 86 nt, Homo sapiens
gcagauaacacguucucuuccugaguccugggcucacagaacauguagcccucauaggcucagggguugauucuggaggacucugc

SEQ ID NO: 2250994 - RNA, 72 nt, Homo sapiens
guuucaacucacagagucagaugagccaccaagguccaagugagcucaccuuaccucuggagcuaaggaaac

SEQ ID NO: 2250995 - RNA, 58 nt, Homo sapiens
cuuuguggcuccugcaggccauuuggauguauacgggcaggucacagggguuacaagg

SEQ ID NO: 2250996 - RNA, 57 nt, Homo sapiens
gugagauuuucuccagguucagaagcaaagaauggacacuacagggagaagacucac

SEQ ID NO: 2250997 - RNA, 56 nt, Homo sapiens
gaaugucauauaauuggaaucagccuuuucaaauuggcuucuaauaauaugcauuu

SEQ ID NO: 2250998 - RNA, 66 nt, Homo sapiens
aaugacagugcuaaagaacccuccuuuacaaacuccucuaccugggacuuucuuaagcacuuuauu

SEQ ID NO: 2250999 - RNA, 85 nt, Homo sapiens
ucugacacacaauugguggucaacuguugauucaugagugaauuuuauugguuacuguugaucgccagugaaauaagugcuuaga

SEQ ID NO: 2251000 - RNA, 84 nt, Homo sapiens
accucaauagagucauuaaggcauucuuugucuucauggcagugaccaggagagaacugaugucuuuaaagaauuccaaggggu

SEQ ID NO: 2251001 - RNA, 60 nt, Homo sapiens
uuuaaguguuuguuccugaaaagcuguauuuuaauugcuuucaggauuuagcauguugaa

SEQ ID NO: 2251002 - RNA, 64 nt, Homo sapiens
uggccucuuugucucuugaucuuuguugguuuaaagucuguuuuaucagagacuaggauugcca

SEQ ID NO: 2251003 - RNA, 66 nt, Homo sapiens
cauagguagcauagcgggaauaucagugguacguuguuccucucuguauuauugcuauggccuaug

SEQ ID NO: 2251004 - RNA, 73 nt, Homo sapiens
aucugucugguuggagaaucacugcaagccaaggcauggcauuggccaauggugauucccggccuccucaggu

SEQ ID NO: 2251005 - RNA, 64 nt, Homo sapiens
uuucugcaccagagaaggcugauguuugaugccagccauggaguucagcagucuggagcagagg

SEQ ID NO: 2251006 - RNA, 78 nt, Homo sapiens
ccuuucucccacucugucuuugucaggaccagaggauguuuggcauuuccccuggucaccaagacaagggagauaagg

SEQ ID NO: 2251007 - RNA, 64 nt, Homo sapiens
ucccuuuugauuucugucuuuuggguucauggucauuaguaucuccacuauagaaugaaaggga

SEQ ID NO: 2251008 - RNA, 70 nt, Homo sapiens
acauuaucgauuaugugccaaagauuuggagaccuccaugaucuguagaacuaguccuuauagauaaugu

SEQ ID NO: 2251009 - RNA, 65 nt, Homo sapiens
cauugucaggcuaggcuggggcauuacaguuuccuuuagcacccucuccuaguccugccaugaug

SEQ ID NO: 2251010 - RNA, 80 nt, Homo sapiens
uagccaaagccacauccagggcauugucuucuuaguaccagaacgcuggaggagccauuuugcccugccuuuggcugcua

SEQ ID NO: 2251011 - RNA, 63 nt, Homo sapiens
cucugagguaagacuaucuagguugaagcuauuaguuaaugauuuagguagcuuuucugggag

SEQ ID NO: 2251012 - RNA, 82 nt, Homo sapiens
uugccuucagggaauguuauuuaauagcauauuugugaucuucuagccuguugugccaaaaaauagcauucccucaaagcag

SEQ ID NO: 2251013 - RNA, 59 nt, Homo sapiens
ucuauauggguuggggggaacagccaaauuuaauuuggcaauaaacuccccuaacugga

SEQ ID NO: 2251014 - RNA, 85 nt, Homo sapiens
ugucugugguacccuacucuggagagugacaaucauguauaacuaaauuugauugacacuucugugaguagaguaacgcaugaca

SEQ ID NO: 2251015 - RNA, 60 nt, Homo sapiens
aucucaacauuaggcauaauaauuagagucuaagcucuuaaaauauggcuauguuuagau

SEQ ID NO: 2251016 - RNA, 92 nt, Homo sapiens
aauggcauggucuugaagcccagggagguuuuaaugugauugucucacuaguaaucacauuaaugcucccucagguucaggaacaugccauu

SEQ ID NO: 2251017 - RNA, 62 nt, Homo sapiens
uagagugcugucaaagacuuguguuacucauuccuaagcauaugucaugcaccagcacuuua

SEQ ID NO: 2251018 - RNA, 59 nt, Homo sapiens
ugagacugagucucgcucuuguugcccaggcugggguacaauggcgcgaucucggcuca

SEQ ID NO: 2251019 - RNA, 62 nt, Homo sapiens
gcugcuauugacauaagaaggccuauguaguccuauguaggccuuuuuaugucaauaucagu

SEQ ID NO: 2251020 - RNA, 57 nt, Homo sapiens
ggguuuuucagacugagugccacugaauaauucuuugucacuggggcuggauaauuc

SEQ ID NO: 2251021 - RNA, 89 nt, Homo sapiens
aucauaugguuuuuguuguugguucuguuuauaugcuggauuauguuuacugauuugcauauguugaaccagccuugcaucccagggau

SEQ ID NO: 2251022 - RNA, 73 nt, Homo sapiens
uuggaauuaaaauggguaauuggcaaauagaaaguauugaaaccaauuuucacagcaauugccuauuguccaa

SEQ ID NO: 2251023 - RNA, 63 nt, Homo sapiens
ucuuaggccugaggcaggacagagaggagcaggguuccuugacacugucacucaggccagaga

SEQ ID NO: 2251024 - RNA, 63 nt, Homo sapiens
guugccuaggcuggagugcaguggcgcgaucucggcucacugcaaccuccgccucccagguuc

SEQ ID NO: 2251025 - RNA, 79 nt, Homo sapiens
uggguuuaaucauauggaucccagcuuacagaagucauguauuaccaccuagugagcuccucucuaugugucagaucua

SEQ ID NO: 2251026 - RNA, 64 nt, Homo sapiens
gguucuucagauaccaucuaauacagagaucuaaucucuguauuagaugguauuugaagauacu

SEQ ID NO: 2251027 - RNA, 117 nt, Homo sapiens
aaauuuagucucaaucaaggcaaccuucaaugauuagaacucauuuccaggaccaugaaguuuugguuuccugggcugauuuuuacaucaaauugcuuugugaccuugagcaaguuu

SEQ ID NO: 2251028 - RNA, 126 nt, Homo sapiens
cucacgucucaagauccaagcuucccaaaguaaagacucaugucccuuuuauaagggcuuacaacucuaagggguccaugugaaaaggucgugauacauugcacaagugggggcuaugugacugag

SEQ ID NO: 2251029 - RNA, 55 nt, Homo sapiens
caggaggcagaguuugcaaugagccaagaucaugccacugcacuccaaccuccug

SEQ ID NO: 2251030 - RNA, 130 nt, Homo sapiens
gagaacaguaaagugcuauguagguauaaaguaucauugugugaguugaugggacuugcuuaaauuuuauuauuuuuagcuguucaauuccaucaucugucauaaauacuuuuaaaauggacagcaucuc

SEQ ID NO: 2251031 - RNA, 126 nt, Homo sapiens
caaaaauaaugaauugaggcauuuaaaaaagacuggaaggaaaaacaaccacagauuuugacagcuauggucuguggguguuuuuugcuuuuuauaguuuucuguguuugcaauuuuucuaaguug

SEQ ID NO: 2251032 - RNA, 90 nt, Homo sapiens
acggcugaucuagugucuuguccguuuuggcuuucucccugauuccagaaugcagguagagauguagagacgugcucucaggacagcugu

SEQ ID NO: 2251033 - RNA, 63 nt, Homo sapiens
cugaggauauucagccucugugguucauuuaauucacacaacacacuggcuguauaucuuuag

SEQ ID NO: 2251034 - RNA, 71 nt, Homo sapiens
gucuccacaaccucaacagcaucuauuguuuuuugaauuuuuaauaauagacauucugacaggugugagau

SEQ ID NO: 2251035 - RNA, 87 nt, Homo sapiens
guagucaagagaucauaugcaguaaugaacucuauggaagaggauuaaauaugacauucauuugguaaaugauuucuguaugauuau

SEQ ID NO: 2251036 - RNA, 84 nt, Homo sapiens
gcagucauaaaguucugcguuagggcuaaaguuaugguagaauuucucuuaguauauuuggcucaacaaacuuuaguucgcugc

SEQ ID NO: 2251037 - RNA, 127 nt, Homo sapiens
caauugagagaccagaaagcaggaccucuuuggaugaggagauauucugcuggauggcuucuuaaaaguuuccucuggaauuaucugccucauuaauaaugguuuuugucuuagaagucucuguuug

SEQ ID NO: 2251038 - RNA, 63 nt, Homo sapiens
ccagugaugcugggggcagcccucuagagccucggguucucaguggcacccccaacaccuugg

SEQ ID NO: 2251039 - RNA, 58 nt, Homo sapiens
gaccucugucuggacauccagguauuuccauacauccugugaaaucuaggcagagguu

SEQ ID NO: 2251040 - RNA, 71 nt, Homo sapiens
gccuuagcaguucauuguugugugaaagugaaugagcuucaugguuuacucaaccgugagccugcuuuggc

SEQ ID NO: 2251041 - RNA, 97 nt, Homo sapiens
ggcaggagaaucgcuugaaccugggaggcggagguuguggugagccaggauugcgccauugcacuccagccuagguaacaagagugaaacuccagcu

SEQ ID NO: 2251042 - RNA, 59 nt, Homo sapiens
uucuacaggcuguucaagaagcauagcucugacaucagcuucugggaaugccugaagaa

SEQ ID NO: 2251043 - RNA, 61 nt, Homo sapiens
gggcacuggcggggcagcucuggcuucucaggagcugaggagaucagccucccugcaaccc

SEQ ID NO: 2251044 - RNA, 79 nt, Homo sapiens
uuggguugguggaaaauuauugcuguuuuugacauuacuuuuaauggcaaaaaccgcaauaacuuuuacaccaaccuaa

SEQ ID NO: 2251045 - RNA, 64 nt, Homo sapiens
aaugccucagugguuucuuuaaaagcauacaguaugcugccuacaagagacucauuguagcauu

SEQ ID NO: 2251046 - RNA, 84 nt, Homo sapiens
gggcuauagacacuaagaggccaaggccagaggggucagcucacaagcucacaagcuccugccuuugcuucguggugcaggcuc

SEQ ID NO: 2251047 - RNA, 122 nt, Homo sapiens
ggcuggucugauuucuagguccuucucccagggcauguggacuuguauguuugacugaaguuccauaagccaaugcuagcccacaugcaagggugacagccaccacuuagccaucacuagcc

SEQ ID NO: 2251048 - RNA, 55 nt, Homo sapiens
ugacaugaagucucccucuguuacccagaugguaacacgggguuacaccguguca

SEQ ID NO: 2251049 - RNA, 60 nt, Homo sapiens
uuugagucugucacucuguugagguuggauccuuauucuaauagcauugauggacucaaa

SEQ ID NO: 2251050 - RNA, 70 nt, Homo sapiens
guucuuuuguacauagcaggccucaauuccugacgucuuuggaaucuguguguaaauaugauagaggaau

SEQ ID NO: 2251051 - RNA, 70 nt, Homo sapiens
uuuacugaauguauaaucugugccugacacuugacuaagagcuuucagguauuuuaucacaugaaguaga

SEQ ID NO: 2251052 - RNA, 70 nt, Homo sapiens
gagcaccuuuccagagcuguuauaagccaaugcagacguauugagcucuuccagccuggagccacugcuc

SEQ ID NO: 2251053 - RNA, 118 nt, Homo sapiens
ucaaucuuuuggaauaguuucaguaagauuugcaacaaucguucuuugaauuucugguagaauuuagcuaugaauucaucugguuuugggauuuuuguuggcuuuuuuaaauuauuga

SEQ ID NO: 2251054 - RNA, 66 nt, Homo sapiens
agcaaaaaugaugacaguacuaggaguugaucaaaacucugccuucccuguggucauuauuuugcu

SEQ ID NO: 2251055 - RNA, 83 nt, Homo sapiens
caucuguuuccuucagcaauauauccccugggucuagcacaaaguagaaacccaauguguauuuguugaaugauggauggaug

SEQ ID NO: 2251056 - RNA, 60 nt, Homo sapiens
gugccguggugguuugcuguaccuaucaaccaucaccuagguuuuaagccccacgugcau

SEQ ID NO: 2251057 - RNA, 70 nt, Homo sapiens
uggaauuaggcuagaauguuauuaaggaaaauuuuugaaugacacuuaguuguauccuaguucaauuuca

SEQ ID NO: 2251058 - RNA, 90 nt, Homo sapiens
auggcacagagguauuggaaggagugucagaugcucagguagaaugaaucuaucaacucuggcacuucuguguacuucugagucugccau

SEQ ID NO: 2251059 - RNA, 87 nt, Homo sapiens
gaggcugcagugagcuaugauggcaccauugcacugcagcuccccagauuggagugcaguggugccaucauaacucacugcagccuc

SEQ ID NO: 2251060 - RNA, 93 nt, Homo sapiens
aaguauuaguagaugguauuauagguuucuguuccucuacacaguccauuuaaggaggaaaaauaguuuuucuaauaccaucuuaagugacuu

SEQ ID NO: 2251061 - RNA, 61 nt, Homo sapiens
ugcaaguucucacuuguaugugggaguuaaaaaauuugaucacauggaggcagagagugua

SEQ ID NO: 2251062 - RNA, 82 nt, Homo sapiens
gccauaguaauccagcaacuucuauucuccaggcagaaagagaaaggaucuuugugcuuaauaaaaagugguaugcuguggu

SEQ ID NO: 2251063 - RNA, 74 nt, Homo sapiens
gucuccaaccagagguauggcacuauccucucugauagcaaaucaagagcacagugcuggcaucuggugaagac

SEQ ID NO: 2251064 - RNA, 72 nt, Homo sapiens
uguacccuaacacccuucagcuuucuuagcucagaggcauuuugagguauggauaucuggagaggaaguaca

SEQ ID NO: 2251065 - RNA, 58 nt, Homo sapiens
ucucagugacugcuggguccccacccuguucaggacuggauuucagcagacacagaga

SEQ ID NO: 2251066 - RNA, 130 nt, Homo sapiens
uccgcgccuccuuucccacggccacgcccuccagagcgcucauuggucagacgcgucgguguugagcgcucgcgccgacgucagccaaugggaggccggagugggaagaaggcggggaagggggggcggg

SEQ ID NO: 2251067 - RNA, 87 nt, Homo sapiens
agguaaacuguguggauaguuuuuuaguaugagucucaugcaauauuugggacauauuuguacuagaaaauuauucuuuguucaccu

SEQ ID NO: 2251068 - RNA, 56 nt, Homo sapiens
uaugacuuuugaauacagauggcugugaaaguaguuucugugguuuaaaauucaug

SEQ ID NO: 2251069 - RNA, 64 nt, Homo sapiens
ggucugagagaguacuugauauaauuuagaucuucuuaaauuuguugagacuuguuuuauggcc

SEQ ID NO: 2251070 - RNA, 79 nt, Homo sapiens
gccacuugaggaggcagucugucccuuagcagaguucaagcgcuuugcugggagaucugcugcucccuucagagauggc

SEQ ID NO: 2251071 - RNA, 72 nt, Homo sapiens
aacaggugguauuugguuuucuguuucugcguuaauucucuuaagauaauggccuccaacuauaucccuguu

SEQ ID NO: 2251072 - RNA, 58 nt, Homo sapiens
acaugcaaauucgugaagcguuccauauuuuuuuggcaaggcauguugguuugcgugu

SEQ ID NO: 2251073 - RNA, 96 nt, Homo sapiens
ccuacauuagagcugugagcagaaguuuugauuggcgucaggugcuacauuuuucagacgccaagauuuguugcucauucgguggugugauauggg

SEQ ID NO: 2251074 - RNA, 75 nt, Homo sapiens
ugagaagcauagaauaugacuuuuagauccaagaacuuaccuacuugucucuuguuaucauuucugaguugcuca

SEQ ID NO: 2251075 - RNA, 103 nt, Homo sapiens
uugagacagagucuugcuguguugccuaggcuggagugcaguggcacgaucucggcucacugcaaccucugccucccggguucaagcaauuuuccugccuuag

SEQ ID NO: 2251076 - RNA, 57 nt, Homo sapiens
ggguggaucacuugagaccaggaguuggagaccagcuugggaaacagagugaaaccc

SEQ ID NO: 2251077 - RNA, 69 nt, Homo sapiens
ccggaaguggccuagagcgaccauuuagcuucuguuguuaaguggaucuaagccuaugucgcuuacugg

SEQ ID NO: 2251078 - RNA, 64 nt, Homo sapiens
ugagauuugggaggagcuaggggcaaaauaauaugguuuugaucugugucccugcccaaucuua

SEQ ID NO: 2251079 - RNA, 61 nt, Homo sapiens
agcaacuucucuggucaagguuacaaaaguagugagugggauugacagagggaaaguugcu

SEQ ID NO: 2251080 - RNA, 61 nt, Homo sapiens
ucuuaguucauuauguguugcucagguaacacaauaccugagaccagauaauuaauaaaga

SEQ ID NO: 2251081 - RNA, 56 nt, Homo sapiens
cugggaggacuugggcugagagcugguggaccagaucuuggguugaauucucccag

SEQ ID NO: 2251082 - RNA, 77 nt, Homo sapiens
gcagcuuguuuuuauagaugcauuuuuauuggaauacagucucaugcauuucaaaaaaauguauugucuguggcugc

SEQ ID NO: 2251083 - RNA, 60 nt, Homo sapiens
gggaagaagucagugucaugcggagucuuggcucuuuacauaugaccugucuuuucucuc

SEQ ID NO: 2251084 - RNA, 79 nt, Homo sapiens
ggaguccuuugggcuucggcagggguuccuguucgcguucacaucaucugcuggccccugaagaaagccuaggacaucu

SEQ ID NO: 2251085 - RNA, 69 nt, Homo sapiens
gauuuggaggcagaagagggauaugaugugacugaaucaugucaggaugcuccuuuuggcuguugaguu

SEQ ID NO: 2251086 - RNA, 128 nt, Homo sapiens
agaaaguuccaugagcuguugaauaaaauguguauucugugcuuguggaugaaguguucuguauguaucuguuaagugcauuuguuccaagguauaguuuaaauccauuguuucuuuguugacuuucu

SEQ ID NO: 2251087 - RNA, 81 nt, Homo sapiens
cugcuaaucuguguucuaauggcugagggauguguuguauauucagcaucacaccuaccucauuauggacaccacaggcag

SEQ ID NO: 2251088 - RNA, 72 nt, Homo sapiens
uaggugagugacucuugcucaggucucuuauggaguugcagucagaaucuuggcaagagcugcauucaucug

SEQ ID NO: 2251089 - RNA, 64 nt, Homo sapiens
auugugaauagugccgcaauaaacauacaugugcaugugucucuguagcagcaugauuuauaau

SEQ ID NO: 2251090 - RNA, 57 nt, Homo sapiens
ucacaaugucugguaggccacuuuggguucuagagguagcauauuccagacuuguga

SEQ ID NO: 2251091 - RNA, 81 nt, Homo sapiens
ucaagauuugaagacauaucuuugcagaaauguuagaacagcaaucugggguuagucaaagguauguaauaaaaaauuuga

SEQ ID NO: 2251092 - RNA, 86 nt, Homo sapiens
guauucgguuggugcaaagguaauugugguuucugccauugaaaguaaaggcaagaaccucaauuaccuuugcagcgaccuaauac

SEQ ID NO: 2251093 - RNA, 66 nt, Homo sapiens
ggauaucucuuaguuuuugccuauaaagaaugacaaccauugaaaguaugagacugggagaaguuc

SEQ ID NO: 2251094 - RNA, 100 nt, Homo sapiens
gaggcaggagaacugcuugaacccgggagguggagguugcagugagccaagaucgcgccauugcacuccagcucuaggugacagagcaaaacuccgucuc

SEQ ID NO: 2251095 - RNA, 72 nt, Homo sapiens
guccaugauuuucugcacuauggaaguauuauuuaacaaauuuguguccacaguggauuaaaguuacuggac

SEQ ID NO: 2251096 - RNA, 94 nt, Homo sapiens
ggaaaugcuuaugucaggccugcaagaugcauaggaauuuuccaaguggggaaggaugacuagcauacuugaugcaaagaguacagcauuuacc

SEQ ID NO: 2251097 - RNA, 77 nt, Homo sapiens
augaacaccagcaggugugguuuucuggggccaagggaggcaucuuugaagacuaccuaccauacuuguuaauucau

SEQ ID NO: 2251098 - RNA, 69 nt, Homo sapiens
gucccuuaagcuauagugaauaaauugcacaauaaaugagcaaggaucuauaaacauagcuccaggggc

SEQ ID NO: 2251099 - RNA, 102 nt, Homo sapiens
ugggacacuuguuacaauggagauuccaaguuccuuuuccuggagaauccgauuccuugaaagaggccuaggaaucuguauuuuuaacucauaacuguccca

SEQ ID NO: 2251100 - RNA, 104 nt, Homo sapiens
ggggggacaucuuaucuuugugacuuuauucaccucuggcuucuaugguagcaagucauuaugucaguggagaaaaggacaugucagccaagaaauaucccccc

SEQ ID NO: 2251101 - RNA, 56 nt, Homo sapiens
gacccuggcuaccugguaggcggaaccaugucacuugugccauguagcacaugguc

SEQ ID NO: 2251102 - RNA, 88 nt, Homo sapiens
ggcugggacugaggucauguucugucagguuccaaagagcgccaggaagacucugagaccacagagcacggccugcuuucucccagcc

SEQ ID NO: 2251103 - RNA, 72 nt, Homo sapiens
ccauuugcaaucuguuagcaguauuuuaguguuucuacuauuuagucaucuguggauaugaguuguaaaugg

SEQ ID NO: 2251104 - RNA, 89 nt, Homo sapiens
guuccuugcagguagguguccuuguguacaagcagcuuccuugugggcaagcuguugguaaaaaggacaugaucacuugacucuggaau

SEQ ID NO: 2251105 - RNA, 64 nt, Homo sapiens
agacauccuugagcagaauuucaugagcaauuauauccacccucugagaugcauugggauguuu

SEQ ID NO: 2251106 - RNA, 82 nt, Homo sapiens
auauuuaccauuaaggcacucuucugugugccugguaugcaccauguaagaaguacagcugccuuugcuaugguuuggaugu

SEQ ID NO: 2251107 - RNA, 59 nt, Homo sapiens
gcccccaucuggcaguaacaagguagugcuccucuuuccuugcugguguuagaggaggc

SEQ ID NO: 2251108 - RNA, 84 nt, Homo sapiens
uccucuucgauaaaguggauucauuuuauuucuaacucaugaaaauuaaauggagaugaaaugagcuacuuaauuaagugagga

SEQ ID NO: 2251109 - RNA, 57 nt, Homo sapiens
uugcaugggagcugggugaggccuguaacugccagcuuucccccacuucccugacaa

SEQ ID NO: 2251110 - RNA, 90 nt, Homo sapiens
gugggcauuugagaacugguagcacuugugauuaugaguaauaauguucaccuccccugcuccucacugucugccaggucucugccucac

SEQ ID NO: 2251111 - RNA, 90 nt, Homo sapiens
gcugaguauuauagugauaggucuacuguaauugcuauaauuaaaaauguaucugggccaggugcaguggcuuaugccuguaaucucagc

SEQ ID NO: 2251112 - RNA, 70 nt, Homo sapiens
ggauccaucagucaguucccaucagaguaacaaaaauuguaaacuaaauaugggacuaacugaugggucu

SEQ ID NO: 2251113 - RNA, 66 nt, Homo sapiens
ucccugacagucacagagcuacaugaacacccauaaaaguggguuuuagcuugucgcagucagggg

SEQ ID NO: 2251114 - RNA, 110 nt, Homo sapiens
aguaggccucaguguuuuuuguucucuauguguccauguguucucaucauuaagcucccacuuauaagugagaacaugugauauuuggugaucuguucuguuaguuugcu

SEQ ID NO: 2251115 - RNA, 74 nt, Homo sapiens
guguuuagcgcaugugaauguguaagaaaaucuccauaggugacuuuuuugauuuacaugcuuaucuguaauac

SEQ ID NO: 2251116 - RNA, 67 nt, Homo sapiens
cacucuggcaggccgaggcagguggauuaccugaggucaggaguucaaaucgagccuggccauggug

SEQ ID NO: 2251117 - RNA, 59 nt, Homo sapiens
aauguguauauauguauggguguguauaaacuguaugugcuuauagguguauguuuauu

SEQ ID NO: 2251118 - RNA, 57 nt, Homo sapiens
guauaaaagcaguucaguggaggaaagcuagccuuucagugacugcugcuuguauac

SEQ ID NO: 2251119 - RNA, 64 nt, Homo sapiens
ugacuuugggacccaacugugguucuagccccuccuugaguccccacacugggucccuugguca

SEQ ID NO: 2251120 - RNA, 81 nt, Homo sapiens
cagaaugugaagugaagcaguagugugggaacccuuuuaauaaggaaagguauacccugcuauuccucauuuaagguuuug

SEQ ID NO: 2251121 - RNA, 80 nt, Homo sapiens
aguauaaauaaaggugcuguaagcauccauguggagggcuuuauguggacauauguuuucagcuccuuuagguaaauacu

SEQ ID NO: 2251122 - RNA, 73 nt, Homo sapiens
uggacacaauaguugcuaccuugugaaagauucauguaauugaccaguguuuaccaaguagcaucuguguuca

SEQ ID NO: 2251123 - RNA, 64 nt, Homo sapiens
uuaaggccugaagcucauaaaggauuaccgaauauuguuaaaacuuugaaagcucaagucuuag

SEQ ID NO: 2251124 - RNA, 83 nt, Homo sapiens
ucagcauguauugugugcucaaugaguauuuauuuguugaacgggugaaugaaugggugaauacaugaaugaauaccuguuga

SEQ ID NO: 2251125 - RNA, 55 nt, Homo sapiens
aagacccauagugugauuaguuugccuucugguuccuuggucccuuuggguucuu

SEQ ID NO: 2251126 - RNA, 66 nt, Homo sapiens
gaacaauaucugccuuccgcauagaaguuugaauuaauuuaaacucuguagcagagacagauguuc

SEQ ID NO: 2251127 - RNA, 72 nt, Homo sapiens
gagccugaggacugagaggcacuguggacaccagacgacaaguucacauuagccucugggucacuuugguuu

SEQ ID NO: 2251128 - RNA, 68 nt, Homo sapiens
uucuggcugauuagccauaaauugggguuaccacagcucccucuuuugguucaauuaauuugcuagag

SEQ ID NO: 2251129 - RNA, 74 nt, Homo sapiens
ugccugaaucauugcauuaucaagggcaucucuuucuaucaagccauuugcucaaagcagugaaaucuucagca

SEQ ID NO: 2251130 - RNA, 84 nt, Homo sapiens
auuucacaaaggaggaaauagaguuaagaaguuaaaugaccugccaagguacuggccuugaacucugguguucucccugggagu

SEQ ID NO: 2251131 - RNA, 78 nt, Homo sapiens
guccuucagauguuuuuguacuucauugucaugaaauccucuggaagcugacuagcagagugagaaacucugagggau

SEQ ID NO: 2251132 - RNA, 120 nt, Homo sapiens
gauugagacagguguauguauucagucuguaucauguuuauguguaggauauguuugcuucaaaauauuuccuugcaacuuaggcauguuuauucauuguuuauucuuacugcaucaauc

SEQ ID NO: 2251133 - RNA, 74 nt, Homo sapiens
ucauucucaauggcccugaguucaauauauuauuaacagcaguauuuuaaaacuuaggguugaacugggcaugg

SEQ ID NO: 2251134 - RNA, 104 nt, Homo sapiens
ucuuuuagcccuucuuagaguaagaugcaccccuuaccgggcuggguuuucaccuuuugaaaucauguauaaaaggggugcacuagcuugccuaagcuaagaga

SEQ ID NO: 2251135 - RNA, 64 nt, Homo sapiens
ccagagguggagccuacagaggcaggcaggccuccuugaucuguggugggcuccacccaguugg

SEQ ID NO: 2251136 - RNA, 63 nt, Homo sapiens
agagaucacugaaucacgggggcaguuucccccauacuguucuagugauuguaagugaguucu

SEQ ID NO: 2251137 - RNA, 70 nt, Homo sapiens
ucacacuugauuuugaaccuuucuacuaaggugcucugguuugguggaaagaacacaaaauuaggaauga

SEQ ID NO: 2251138 - RNA, 80 nt, Homo sapiens
gguagccaauuguguggaguuuuucuacaaccugagcagaccagcuguagcaaaucgauacuauuggaucaagagcugcc

SEQ ID NO: 2251139 - RNA, 58 nt, Homo sapiens
caggguagacaguaggugucuguguccagggcucacccuauaccucugugaaccccug

SEQ ID NO: 2251140 - RNA, 73 nt, Homo sapiens
gaggccagacuagagagccaaccgucagggagccgagcagccucuggcuuggcuggcaucucugcccagucuc

SEQ ID NO: 2251141 - RNA, 75 nt, Homo sapiens
aaugggaguucuguguuuuguguggcagguccucacaucucccuggauuccagcuccaucacagagucuuccauu

SEQ ID NO: 2251142 - RNA, 71 nt, Homo sapiens
uagggaugagguaucauuauguugcccaggcuggucuugaacuccugggcucaagugauccucucgccuug

SEQ ID NO: 2251143 - RNA, 64 nt, Homo sapiens
ugagacauauuauacugcuuuuaucuuuacuuuugaaaggcaaugcagucauggaaugcucuca

SEQ ID NO: 2251144 - RNA, 80 nt, Homo sapiens
cucaagcuuggcucuacgcguuuccuugcuuugcugugcuccaggggagucacugagcagaaggaagcgaguugccugag

SEQ ID NO: 2251145 - RNA, 93 nt, Homo sapiens
ucugcuccucuccuuuguaauuuauauggaauuguugcucagaaaggcaguuaucugaaguaccauuagauuaggaugacaaggaagagcaga

SEQ ID NO: 2251146 - RNA, 122 nt, Homo sapiens
uaaucugcaaaucuguguaucaucaugagauaaagcaaauaggacuauugcauuccaauucuguacagucuucuuaaugcuuuucauccucugugauuuauauuauucaagauuucauauug

SEQ ID NO: 2251147 - RNA, 98 nt, Homo sapiens
gaggcaggagaaucacuugaacccaggaggcugagguugcagugagcugagaucaugccacugcacuucagccuggugacagagugagacuccaucuc

SEQ ID NO: 2251148 - RNA, 61 nt, Homo sapiens
ucuggguuuuguaccgugcucgucccaaagggcaacaugacuccuuggugugaaaucuaga

SEQ ID NO: 2251149 - RNA, 78 nt, Homo sapiens
aaugauugcuagggagaauuauuggauacaggaacagagauuaucuuguaauuuaaaugauccuuggaguuagucauu

SEQ ID NO: 2251150 - RNA, 78 nt, Homo sapiens
aggagggguuugagcuggcuguggagaaaccccugccuauggucucaggguuccacuggccacuaauaagccuuucuu

SEQ ID NO: 2251151 - RNA, 119 nt, Homo sapiens
ucagucucucucacuaaauucucucccuaauguagguagggucuguuuuugaucacuguguaccucccgcaccugucaagggucuaggccuggcccaccguagggauaauagggacuga

SEQ ID NO: 2251152 - RNA, 70 nt, Homo sapiens
guaauuuauguuugacuacaggcuauauugggaagaaauauaugcuaauuuuuagucgagcauuguuugc

SEQ ID NO: 2251153 - RNA, 94 nt, Homo sapiens
gaggucuccuuuguauguguuguuauguuacaggaaugggguguauugauucugagcaauaaacaacauauuuuuaacauucaggauugacuuc

SEQ ID NO: 2251154 - RNA, 60 nt, Homo sapiens
gagaaugaugguuuccagcuucaucgaugucccuacaaaggacaugaacucaucauuuuu

SEQ ID NO: 2251155 - RNA, 58 nt, Homo sapiens
ccauggcaauggucagucuauucaaacauaagccuggcauggugcuggccucccaugg

SEQ ID NO: 2251156 - RNA, 91 nt, Homo sapiens
cacuuuacacuguaucuuccuccaggcaauugaguuauuuggaaccagcuaggggucagugucugugauggagaggugcagucuugaggug

SEQ ID NO: 2251157 - RNA, 84 nt, Homo sapiens
uugcauagauaucuggauaggaguaaaacauggacuuagaagaauguggcuucaaagucuauucuacccuuaccagcuguguga

SEQ ID NO: 2251158 - RNA, 59 nt, Homo sapiens
gguauuauagguugcuguggggcuugaauaaaauagccaucagagugagauauaagauc

SEQ ID NO: 2251159 - RNA, 80 nt, Homo sapiens
cauggcuuuuuucuugggcacucuuuugcugucucugagugaagccagcugucaugagcugcccaguggagagggccaug

SEQ ID NO: 2251160 - RNA, 76 nt, Homo sapiens
aaaaugggagcauggcuuucacaguaaagccuuuuguuagugcugagggcuuacacaaaggcacaguuccccuuuu

SEQ ID NO: 2251161 - RNA, 67 nt, Homo sapiens
gugcuuuguuguggcaguggcagugggauccgugcuuacaugugugugccagcagccacagcagcac

SEQ ID NO: 2251162 - RNA, 100 nt, Homo sapiens
gucaugaggguuugugaagauuaaaugagauaacacugaguaagcacuuaaaauguaauguuucaucauuauuaauauagucuuuauuuucucugaugau

SEQ ID NO: 2251163 - RNA, 55 nt, Homo sapiens
guuuugaauacuacuagaacuugggcagguccuacaaacuuggugguguugagac

SEQ ID NO: 2251164 - RNA, 84 nt, Homo sapiens
cuauuagguugugaaaagcaauugcaguucuugccaucacuuucaauggcaagaaccacaauuacuuuugcaccagccuaauag

SEQ ID NO: 2251165 - RNA, 79 nt, Homo sapiens
uuacucacugugcuagcugcuguauguacacggauaaaucagauggucuuaucucccagcaguucauagucuagaggga

SEQ ID NO: 2251166 - RNA, 97 nt, Homo sapiens
aauauccuaggggaauauuacuccugaugacacgggagauguacaccaugugugucaaccgccugugucauuauucguaauauccuagggggauguu

SEQ ID NO: 2251167 - RNA, 58 nt, Homo sapiens
augccagacauuuacaaauguccuuuguugacuauggaaccauguaaauguuuugcau

SEQ ID NO: 2251168 - RNA, 94 nt, Homo sapiens
augugcugguuuagaguguuagaaauggauauuguauuaguucucuaugcuucauaaugaguuaucacaaacuuagcaguuuaaaacaacacau

SEQ ID NO: 2251169 - RNA, 120 nt, Homo sapiens
uauaguuguucacugagauucuucuuauauaugucaacaguguuuuggguuuucuggcccuaucagaggaauuacggagauuguauguguaagagguuuccugaaguggaauaaccugug

SEQ ID NO: 2251170 - RNA, 76 nt, Homo sapiens
uugcuugaacccgggaggcggagguugcagugagccaagaucgagccacugcacuccagccucggugacagaguga

SEQ ID NO: 2251171 - RNA, 59 nt, Homo sapiens
agagauaauuagguuaaaugaggccaugaguggccucauccaauaugacuguuaucucu

SEQ ID NO: 2251172 - RNA, 61 nt, Homo sapiens
ucuauuuuguuaaccuuuucaaaaaaccagcuccugguggcuggcaagauggcagaauaga

SEQ ID NO: 2251173 - RNA, 58 nt, Homo sapiens
gaaucacugugguaucccaugcuuggaaugucaguaaagguguggccaauagugauuu

SEQ ID NO: 2251174 - RNA, 89 nt, Homo sapiens
augcaguuuuaaaugggccuauuuacuaaccaagaaguuauuuuaauagcuaauaucuauugguugaaauugcuuuuuaaauauggcau

SEQ ID NO: 2251175 - RNA, 55 nt, Homo sapiens
cauguuaguuaccuguuucacguuaguuaccuguuucagguagugugcugacaug

SEQ ID NO: 2251176 - RNA, 63 nt, Homo sapiens
uaugacugaguaguauuccacuauauguguauauacauauaguggaauacuacucaguauaua

SEQ ID NO: 2251177 - RNA, 96 nt, Homo sapiens
ggcaggagaauugcuugaacucgggaggcggagguugcagugagccgagauggcaucauugcacuccagccugcggaacaagagcaagacuucguc

SEQ ID NO: 2251178 - RNA, 62 nt, Homo sapiens
ucuagaguagaguuuccuuaggaaagcacuggagcuuuucuggaaggauguuucuaucuaga

SEQ ID NO: 2251179 - RNA, 78 nt, Homo sapiens
agauuuaaucuuguaacaguuuauugacucgaaacaccuuaaauaaugguuuggggaucuguacuguagcaagaaucu

SEQ ID NO: 2251180 - RNA, 96 nt, Homo sapiens
gaugggaggaucaccugaggcugggaggcagagguugcaaugagccaagauugcaccauugcauuccagccugggcaacguagugagacccccguc

SEQ ID NO: 2251181 - RNA, 66 nt, Homo sapiens
gcugagcuagaccacuuggcuccccggguucagccccuucuaggggagugaaugguucugucuugc

SEQ ID NO: 2251182 - RNA, 91 nt, Homo sapiens
gcucagggugagagugggccugcagguucugagaggcugggcuggggacaguugucucccaaccccugugcccagucuucuugccaggagu

SEQ ID NO: 2251183 - RNA, 59 nt, Homo sapiens
gugugguuuuuagauuucuacagucuuucucuuaagauuuaggaauauagaaaccaugu

SEQ ID NO: 2251184 - RNA, 60 nt, Homo sapiens
uugacauguaaguacucuauagguaaaaagccauucucaccugucagggauaugugucag

SEQ ID NO: 2251185 - RNA, 70 nt, Homo sapiens
ggaaagaaacuuaggcaauacuuccauugacuauugacaggccaaugauacuguucuaagauuuuuuucc

SEQ ID NO: 2251186 - RNA, 56 nt, Homo sapiens
acuucugccuagauuucagaggauguauggaaaugccugaaugucaaggcagaggu

SEQ ID NO: 2251187 - RNA, 55 nt, Homo sapiens
gaucacagugaaaacagucaauucauaagaugaguuaauuaaggaggcugugauc

SEQ ID NO: 2251188 - RNA, 89 nt, Homo sapiens
uuuggggcuaaaaacuuccuuguuuuguuauuguaucauauuggagcucacauauuuugaugagaggugauaaagcaaggguccccaga

SEQ ID NO: 2251189 - RNA, 113 nt, Homo sapiens
aacauuuuuuccuucauuucaaccuuggugaaucugacaauuaugugucuugggguugcucuucucgaggaguaucuuugugguguucucuauguuuccugaauuugaauguu

SEQ ID NO: 2251190 - RNA, 79 nt, Homo sapiens
uuucaugucaagugacuagaauaugaauuuuaauaauauacuaugaaauuagaaaaugugauagucacagauuauggaa

SEQ ID NO: 2251191 - RNA, 81 nt, Homo sapiens
ucaccguugucccaaaacuugaagcaagccucguauccaaggggccaggcauguugcuucgggcuuugugcaaacaggugg

SEQ ID NO: 2251192 - RNA, 78 nt, Homo sapiens
agugucuugauacuguuuuugagaauaguaaugcuucaaauauuuggagcaccauuucucuaaagcacucaaaacgcu

SEQ ID NO: 2251193 - RNA, 57 nt, Homo sapiens
aaauagagugcuucaucaguaguaagggugaauacugcuuccugaagcucuuuuuuu

SEQ ID NO: 2251194 - RNA, 57 nt, Homo sapiens
cucaccuugugauccacccgccuuggccucccaaagugccgggauuacaggcgugag

SEQ ID NO: 2251195 - RNA, 55 nt, Homo sapiens
ccaauacauagugaugaaaggcagauaaguggcugucuuugguugagcguguugg

SEQ ID NO: 2251196 - RNA, 55 nt, Homo sapiens
uugagaucaugcuacugcacuccagcuugggugacagaguaagaccuggucucaa

SEQ ID NO: 2251197 - RNA, 75 nt, Homo sapiens
cauuauuacauucagcuguuguuucaaugugucugaaaggguaaaugacuauuuagauggccuggguguguggug

SEQ ID NO: 2251198 - RNA, 68 nt, Homo sapiens
auuuccagcaauacuacauuccuuuugggaaagcacuccauaauucauggaugagucauuguggaaau

SEQ ID NO: 2251199 - RNA, 58 nt, Homo sapiens
acuuuguguuacccagcaaggacuaaccaagguuuccuucugaaaaaugcacacgagu

SEQ ID NO: 2251200 - RNA, 85 nt, Homo sapiens
ugucuauaacugccuuucuuucccugauuuuaagauaugugacuugaauucacaugugaagauugggaguaggcugggcugggca

SEQ ID NO: 2251201 - RNA, 56 nt, Homo sapiens
cagaggaguaacaugaucucaccuggguuucagaugagaucagaaggauuucucug

SEQ ID NO: 2251202 - RNA, 72 nt, Homo sapiens
gauaagcuaagaguuucugggcuucuucaggaaaaucccucaggaacagagccuagaaagcucuagauuguc

SEQ ID NO: 2251203 - RNA, 86 nt, Homo sapiens
uuuguuaaugugucuguuugauccagaucaaaacauagaucaagagaucuuguuuuuggguggaauaaguagagauuguuaacaaa

SEQ ID NO: 2251204 - RNA, 116 nt, Homo sapiens
gugcuaugaagccaucaugugagugcucaugggcagugugauuguuuaugugaguuacacgcauuuauuagcaaucauacagcuccuugggaacuuagcaugugggcaacaagcau

SEQ ID NO: 2251205 - RNA, 109 nt, Homo sapiens
ugagaaccacuacaguggauaugggaagauauaggcugggcaccaauggcaucugcuaauggugggucuauauauccuauguuuuaccugucaccauccuagguucuua

SEQ ID NO: 2251206 - RNA, 72 nt, Homo sapiens
ucuuuuuagcagcaccccacucuacugguaccaauuuauuguauuaguuuguuuucaugcugcugauaaaga

SEQ ID NO: 2251207 - RNA, 58 nt, Homo sapiens
acccgggagacggagguugcagugagccaagauugcgcuguugcacucuagccugggu

SEQ ID NO: 2251208 - RNA, 104 nt, Homo sapiens
ccagacaauagaguacaucccguaagauucuauuuuuguggaacuguagaauaggcaaagucaaucuauggugauagaaaucagaaugggugccuccggucugg

SEQ ID NO: 2251209 - RNA, 101 nt, Homo sapiens
ucauauuugcgcaaaguucuagaggagcacggauucugcuuugaagaucagagaagcugugucuugaaggcugaguaccuguucuaagaucaaagaaaugg

SEQ ID NO: 2251210 - RNA, 81 nt, Homo sapiens
accugaggcauugucuacauuaggguuauaugaguucacucgcaagggguugcuguaugguugaagugacaagccaaaggu

SEQ ID NO: 2251211 - RNA, 72 nt, Homo sapiens
gugcauggaaggagaggaaugaaugacuguugaagccagauggccuugcucauugauucucuccuuucccgc

SEQ ID NO: 2251212 - RNA, 66 nt, Homo sapiens
gucagugccugucccaggcuuugaucagcuucauucauucagucagugccugucccaggcuuugau

SEQ ID NO: 2251213 - RNA, 57 nt, Homo sapiens
uaacaagagagucagucaguccuuugaagacaggcauugaccucuccucucuaguua

SEQ ID NO: 2251214 - RNA, 96 nt, Homo sapiens
gauacauaauuaaaucauccauuauguaaccacuugagauuggcuuuuucacucugcauaaugcccuugagauucauccaaguuguugcauguauc

SEQ ID NO: 2251215 - RNA, 55 nt, Homo sapiens
gcggccugggggagcagccuuagugucuuccugcugaugcaauccgcuaggucgc

SEQ ID NO: 2251216 - RNA, 71 nt, Homo sapiens
gguucucuguuuguuuaggguacucagaauauuacucagagauaucugguuacuuuccuaaagaacaaacc

SEQ ID NO: 2251217 - RNA, 58 nt, Homo sapiens
gugccuucuagcuaugguuggccacaugacuacguucuggccaaugggauaggagcac

SEQ ID NO: 2251218 - RNA, 59 nt, Homo sapiens
caguaaauaucugagcgaggucuggaaccagcccagucugacugccaugauauuugcug

SEQ ID NO: 2251219 - RNA, 58 nt, Homo sapiens
gggacugauauuguuuuauugccugcuauguuucagggauuuuaaauaugucaguucu

SEQ ID NO: 2251220 - RNA, 63 nt, Homo sapiens
gcaggcaccaugagcaucauggguacaaaaggaguccaauuucaagugcaucguugugucugc

SEQ ID NO: 2251221 - RNA, 82 nt, Homo sapiens
ugauuguggugaauaagcuuuuuaaugugcugcuggauuugguaugccaguauuuuauugaggauuuucgcaucgacguuca

SEQ ID NO: 2251222 - RNA, 75 nt, Homo sapiens
uuguuuuguuugagauggaguuuuacucuuguugcccagacuggagugcaauggugccaucucggcucaccgcaa

SEQ ID NO: 2251223 - RNA, 71 nt, Homo sapiens
agcacugcaccauugcauacuuaauuaaaccguauuagauauuuuaauuaagcauacgauggugcagagcu

SEQ ID NO: 2251224 - RNA, 78 nt, Homo sapiens
gacuguccuagaagagacgaggaugggugaugucugggaucaggcuggauucucaugcugucuucugggguaacaguc

SEQ ID NO: 2251225 - RNA, 74 nt, Homo sapiens
agagcacaguuuagcuggagccucugcucagcaucucacaaggcugcaaguaaagcaucagcuagauguguucu

SEQ ID NO: 2251226 - RNA, 63 nt, Homo sapiens
gcauauauuagaugauuugccuuacauaugucuucauugagguagaaugauucuaauaugugu

SEQ ID NO: 2251227 - RNA, 66 nt, Homo sapiens
uguuggcaauauauucugaauucaguuuaucauuggaauugggaucucagauauauuauguuaaca

SEQ ID NO: 2251228 - RNA, 81 nt, Homo sapiens
gggacuccuggcuuugcaagaaaucagagccuucccaggcauaggggagccuuggagauuucugcaaggagccucaguucu

SEQ ID NO: 2251229 - RNA, 62 nt, Homo sapiens
ugacccauagaaauguggauaauaaauguuuacugcuuuaggcugcuacauuuuugggguca

SEQ ID NO: 2251230 - RNA, 69 nt, Homo sapiens
gcagguggguaagcaguguggauccaccuuggguugcaacccuagguggguccacgcugcucugcuugc

SEQ ID NO: 2251231 - RNA, 55 nt, Homo sapiens
cagccggguggcuccuaggguaauuaaaccuguugccgugcggccccacccguug

SEQ ID NO: 2251232 - RNA, 77 nt, Homo sapiens
gcaauuucagaggguagagaaaucacaagugguguaagaaccaaacugugcaugaaauuuaccuuuaaugcauuugc

SEQ ID NO: 2251233 - RNA, 58 nt, Homo sapiens
cugaggaauguggccaccucccugcacccuuaaagcugagcagccacagauuccucag

SEQ ID NO: 2251234 - RNA, 66 nt, Homo sapiens
cugaaguuggugagauaucugcugauguuuaagauguaagcaaggugguaucuuacucaugaucag

SEQ ID NO: 2251235 - RNA, 66 nt, Homo sapiens
gugucaaggaugccugucaggcacuuguaccaacaauguuuugaagccaugacaucauuuugacac

SEQ ID NO: 2251236 - RNA, 76 nt, Homo sapiens
uaaucuagauguugcuugaaggcauuuuguagaugugauuugucuauaauuaguuuacuucaaguaagggagauua

SEQ ID NO: 2251237 - RNA, 56 nt, Homo sapiens
uugcuauaaagacacgugcacacguauguuuauuguggcacuauucacaauagcaa

SEQ ID NO: 2251238 - RNA, 64 nt, Homo sapiens
auuaggaagcuaauaucuguauccucuaugguuaugagauagaugaagauguugccuuuuuaau

SEQ ID NO: 2251239 - RNA, 72 nt, Homo sapiens
ucacuuagcagccuucaagcuccaagauguguuuauucuaaggccuugagcuaacuugaggcuggccagugg

SEQ ID NO: 2251240 - RNA, 76 nt, Homo sapiens
aaacuuucagagaaagugcuuugugauguuugcauucauaucacagaguuaaaacuuucuuuugauugagcaguuu

SEQ ID NO: 2251241 - RNA, 92 nt, Homo sapiens
caaggugcagacaggauuacuucccucuggaggcuccugggaagagucucaucccugcucuuuugguuucuagaggccgccuuuguaucuug

SEQ ID NO: 2251242 - RNA, 58 nt, Homo sapiens
uggaugacauccuuguaugcagacccacuaaagaggccucagauaagaauguuauuca

SEQ ID NO: 2251243 - RNA, 66 nt, Homo sapiens
ugugcacaugguagguauugaguaugugaauuauugaacauguacuuuagauaaauuaugugcaca

SEQ ID NO: 2251244 - RNA, 55 nt, Homo sapiens
uugggcgugaggagagggugaaucuguguccagggcuccccaguuuuccguucag

SEQ ID NO: 2251245 - RNA, 60 nt, Homo sapiens
guaacaccagggagcucuuaccugcuaguuguauuggcaauaaggacuccuuagguuugc

SEQ ID NO: 2251246 - RNA, 100 nt, Homo sapiens
uaauacuggcauuguagaaugaguuuggaaauauuaccuccauuuuucagaauaguuugaguaggauugguauuucuucuuuuuuauauguuugguauua

SEQ ID NO: 2251247 - RNA, 82 nt, Homo sapiens
uuaaaauuaguugcauucaggauaugacgaucgaauauaauaguuuauagauuaugcguccauauucaugagcugaguuuaa

SEQ ID NO: 2251248 - RNA, 107 nt, Homo sapiens
uaagcacucauuuugguugaguucauaugcaggagcggaauuucuucgucauagaaugaaauguauguuuggcuuuuguaauaacugccaaagugauuauguguuua

SEQ ID NO: 2251249 - RNA, 63 nt, Homo sapiens
ugaaacauacacucugauggggaagcgaagcgcagagaugcucaucuaguguaugugaauuca

SEQ ID NO: 2251250 - RNA, 61 nt, Homo sapiens
uuccuugugacuaguagugaccacguggccagccaauguagcacagccagugaugaaggga

SEQ ID NO: 2251251 - RNA, 99 nt, Homo sapiens
ggggcagagcccagcaagcaguguuuuuaacaggugcccggaugugucugcagcucacacuuggagaaacacuagccucuguuaggaguuaacuguccc

SEQ ID NO: 2251252 - RNA, 90 nt, Homo sapiens
aaggucagauauguaguaguugaaaaagaaguaggguuaaaaauaauaauaauacccuucccucugacauuaaucauugauauugaccuu

SEQ ID NO: 2251253 - RNA, 129 nt, Homo sapiens
auuuauuuuuauucagucuuauuucucauaaaugaaguuaagaauguuauugcuuuagagcuucuuuugggguauuccugaaguaauaaauggauucuuaacauuugggguauuccugaaguaauaaau

SEQ ID NO: 2251254 - RNA, 93 nt, Homo sapiens
auguuuuaagguuaagguuaggaaguaauaaguuugguucuaauccaaauauuggugccugauucuguguuauuuauaacugccuuguaacau

SEQ ID NO: 2251255 - RNA, 62 nt, Homo sapiens
agguugagauagucuacagggaaaauguugaucauuucuacauuuguaaacuaccucaaccu

SEQ ID NO: 2251256 - RNA, 81 nt, Homo sapiens
guaguucaagucuuaguucuuagaggaaucaacauuuacuuuuguuauuauucccuguagaauaaggauggacuggacuau

SEQ ID NO: 2251257 - RNA, 72 nt, Homo sapiens
acuugaaccccggaggcggagguugcagugagccgagaucgugccauugcacuccagccugggggacagagu

SEQ ID NO: 2251258 - RNA, 64 nt, Homo sapiens
ucaggugcagagaagaaaugggagcauuccccuaaagcccccucucauuccuucauguaccugg

SEQ ID NO: 2251259 - RNA, 56 nt, Homo sapiens
ugauaugacagcucugcugccauggucagaaaccaaucuggcuugcugucauguca

SEQ ID NO: 2251260 - RNA, 72 nt, Homo sapiens
uuguuuuugagacgaagucucacucuugucccccaggcuggagugcaauggugcgauuucggcucacuacaa

SEQ ID NO: 2251261 - RNA, 64 nt, Homo sapiens
uuaaccauuaagggucaggaaauugacuuccuccuggacacuggcuuggcuuucuugguguuaa

SEQ ID NO: 2251262 - RNA, 64 nt, Homo sapiens
uggagauuucacuuucuggaugugcauguugaauuagcugcacgaaccuggaaugaaaacucua

SEQ ID NO: 2251263 - RNA, 56 nt, Homo sapiens
uaaaguucuuuuaugggccgggcacaauggcucacgccuguaaucccagaacuuua

SEQ ID NO: 2251264 - RNA, 96 nt, Homo sapiens
aucuauaaaauggggauuuauauuuaucucuuaugauauaaggaugguaaaaaauagcucaucauggagaugauuaugaaucacuuauauguggau

SEQ ID NO: 2251265 - RNA, 63 nt, Homo sapiens
uucacuuaauugucuucugugccauaugacaggcagaucacuuuaggagcaaugagaguagaa

SEQ ID NO: 2251266 - RNA, 57 nt, Homo sapiens
gggguuccuggccugucagaaagugacauucuuuacuuaucacaggucagaaacccu

SEQ ID NO: 2251267 - RNA, 76 nt, Homo sapiens
caggggcuuucucccucacaaagcauucucuucauggaaggaugaugaaguaaaucuuaugucagggagccaccug

SEQ ID NO: 2251268 - RNA, 62 nt, Homo sapiens
uuagcugcugcuaggcuaaggaugagugaaaucuacaagcacaaccccuggcaugcaguugg

SEQ ID NO: 2251269 - RNA, 65 nt, Homo sapiens
gaagagcuagugcuuaugcaccacucucucuccugucugugagagugacucacacuagcugcuuc

SEQ ID NO: 2251270 - RNA, 55 nt, Homo sapiens
guuucaggcaccauugucauugauaacaucuuaucaggagacaggguuuugagau

SEQ ID NO: 2251271 - RNA, 57 nt, Homo sapiens
ucugauggaguugccagggagagcucacaaccaugcuucaucugcuacuaccacagg

SEQ ID NO: 2251272 - RNA, 61 nt, Homo sapiens
aguuuuugaaugaacauugcuaugugguuauaaacugauggcaauggcauucauuuuaacu

SEQ ID NO: 2251273 - RNA, 82 nt, Homo sapiens
gugggaaguuuagagaguuguuuuaaggcacugacuuuuaaaaguaggguuaguuguugagaauaacagaagagguuuuagu

SEQ ID NO: 2251274 - RNA, 68 nt, Homo sapiens
ggauuuugagguuauuuguucaagaaguuagcuuccccuaacucuuacauagaccucauugaaaaucc

SEQ ID NO: 2251275 - RNA, 90 nt, Homo sapiens
gugggugacucaguccugcuggggacccuuugagagacacagagcacgugcuucugaaucguucccaugcaggacgggaggcaggcccac

SEQ ID NO: 2251276 - RNA, 61 nt, Homo sapiens
gcucauuaguuuagugguaccuggccaauaaguagccaugauaugacaaagccuagugagu

SEQ ID NO: 2251277 - RNA, 107 nt, Homo sapiens
uuuaaaucugcauguggggacuacuuuaucucaguguacaggaugauaaaauggaaauuggugucacauucugaugugaggugagaaaccauaauguggaauuugaa

SEQ ID NO: 2251278 - RNA, 100 nt, Homo sapiens
gaggcaggagaauugcuugaacccgggaguuggagguugcagugagccgagaucaagccauugcacuccacccugggcaacaagagcaaaacuccgucuc

SEQ ID NO: 2251279 - RNA, 57 nt, Homo sapiens
uauacuucauaaagugcuaucagaugauuguuccauuugagauccacgugaaguaug

SEQ ID NO: 2251280 - RNA, 77 nt, Homo sapiens
ucagcugaacuaguacacacuuacauaacugugaguuaugugaguagcugugaguguguacuaguuaucacaguuga

SEQ ID NO: 2251281 - RNA, 69 nt, Homo sapiens
guguuuaauauguccuugaaauggugcuucuacuuggagcaccagaggcaaggucauagcagccaacau

SEQ ID NO: 2251282 - RNA, 87 nt, Homo sapiens
ggcaccaggggauuuaauagcaaagaguuuagacucaagucauccuugguucaagucuugccucugcuacuuagcaucccggugacu

SEQ ID NO: 2251283 - RNA, 70 nt, Homo sapiens
cuugaacccaggaggcggaaguugcagugagccaagauugugacauugcacuccacuccugaacaacaag

SEQ ID NO: 2251284 - RNA, 74 nt, Homo sapiens
uuucuuauuuggcuaugaguccuaugugcauugguacucauagccugugcauaaccucacucauagccuugaaa

SEQ ID NO: 2251285 - RNA, 63 nt, Homo sapiens
cugcuaaggagcaguggacggguccuagcacgugcugugagccacccgcuguccagggagcgg

SEQ ID NO: 2251286 - RNA, 77 nt, Homo sapiens
ucgcuugaacccggaagguggagguugcaguaagccgagaucgggccauugcacuccagccugggugacaagaguga

SEQ ID NO: 2251287 - RNA, 101 nt, Homo sapiens
ugagauggaguuuuacuuuguugccuaggcuggagugcaguggcgcgaucucggcucacugcaaccucuaccucccagguucaagugauucuccugucuca

SEQ ID NO: 2251288 - RNA, 58 nt, Homo sapiens
uaacagaccuagauaguauagucuacuacacaccuaggcuauaugguauagucuguua

SEQ ID NO: 2251289 - RNA, 71 nt, Homo sapiens
auuugugccuuuucugagcaaugagcagagcacuguguguguggccauagugucaggaaagggucgcaagu

SEQ ID NO: 2251290 - RNA, 81 nt, Homo sapiens
acauuaagauuuguucaaucugagugauggguaaagcaauguuugcaauauccucuacuauagguucuacauguuuuaugu

SEQ ID NO: 2251291 - RNA, 63 nt, Homo sapiens
cuugugccacuguuggccaucccuccuccuggggcugugaaacaugaccuauggugguauaag

SEQ ID NO: 2251292 - RNA, 63 nt, Homo sapiens
cauaucagaguugucagggagcuuuagaaacaccaucaaaugcaacccucauaccucugugug

SEQ ID NO: 2251293 - RNA, 76 nt, Homo sapiens
uagggcuugacacuaauuauuauaggugauauauuaacccagauaucagugccaccaauuaguaagucaaccucua

SEQ ID NO: 2251294 - RNA, 59 nt, Homo sapiens
ugggugcaggaaaacuaccuggaguaccggcagguacccggcaguaauccugcgcgcua

SEQ ID NO: 2251295 - RNA, 76 nt, Homo sapiens
ugugagaaauaaauuucuguuguguauaaauacucagucuaaaguacuuuguuauagcagcaggaauggacuuaca

SEQ ID NO: 2251296 - RNA, 64 nt, Homo sapiens
uuuuuuugagauaguacuuuuuaaagagauaguacuuuuuugagauaguacuuuuuuaaaggga

SEQ ID NO: 2251297 - RNA, 60 nt, Homo sapiens
guauuagguuggugcaaaauugacaauggcaaaauacacaauuuugcaccaaccuaauau

SEQ ID NO: 2251298 - RNA, 97 nt, Homo sapiens
augaggaaaagagaaaggacuugggaaagaaguuucaccgauacugguuuaugguucuugagacauuguuuuccaaguuguuuauauacaguuucau

SEQ ID NO: 2251299 - RNA, 79 nt, Homo sapiens
uaaaugcuuaauugaauguggaacucaacugugcauuaucuaugcagauguaauauuguucacguuuguugaguauuua

SEQ ID NO: 2251300 - RNA, 67 nt, Homo sapiens
gcuuccuuguuuauuuacaggaggaaaagagaacuggcuucucuuguucugaagaaagcaaggaagc

SEQ ID NO: 2251301 - RNA, 64 nt, Homo sapiens
uagguaaguaugugugauggggauuuguugcacagauuauuucaucacucaggcauuaacccua

SEQ ID NO: 2251302 - RNA, 67 nt, Homo sapiens
gucuuagcaugucagcaccggguuuauaacaccuugaugguguaauccacacaucuggcaugugagc

SEQ ID NO: 2251303 - RNA, 60 nt, Homo sapiens
ugcugggauuacaggcaugagccacugugccuggcugcauugucccucuuaaucccagca

SEQ ID NO: 2251304 - RNA, 130 nt, Homo sapiens
guguguauauauacauauguacacacguguguauauauacauauguacacacguguguauauauacauauguacacacguguguauauauacauauguacacacguguguauauauacauauguacacac

SEQ ID NO: 2251305 - RNA, 75 nt, Homo sapiens
agaugaguugugcuugcuguguucuaugccagguguuaaguggacaggaacugagcaagcacugaggauucgucu

SEQ ID NO: 2251306 - RNA, 67 nt, Homo sapiens
uuucagaucaucugggucccaugaucuuauuucauagaugagucaauggaggcucagagccaugaag

SEQ ID NO: 2251307 - RNA, 99 nt, Homo sapiens
gaggcaggagaaucgcuugaacccaggaggcggagguugcagugagccaagaucgugccacugcacuccagccucggugacagagcgagauuccgucuc

SEQ ID NO: 2251308 - RNA, 72 nt, Homo sapiens
uauuuguaaagcuacaggaccugcucauucgccuggacaggugagugcgggugguguguggcguuccaaaug

SEQ ID NO: 2251309 - RNA, 55 nt, Homo sapiens
uuccaguugagugaaaacacagugaaccagggcuuugagcuugacucagcuggag

SEQ ID NO: 2251310 - RNA, 58 nt, Homo sapiens
ggugcuggggauuucaugauaaacaagauacucccugcugucaaggaauucccaaauc

SEQ ID NO: 2251311 - RNA, 71 nt, Homo sapiens
cacaauugaagggagaaauggacugaagcacaauaauacuaagagauuucaguacuccacuuucaauagug

SEQ ID NO: 2251312 - RNA, 66 nt, Homo sapiens
ugucaaggcauagcugacauacaauaaaauaaacccuuuuguuguauaguucuauguguuuugaca

SEQ ID NO: 2251313 - RNA, 64 nt, Homo sapiens
guauggcaugcaugagaauuucccccuuucuaaggcugaguaauauucuagugcauguacauac

SEQ ID NO: 2251314 - RNA, 74 nt, Homo sapiens
uggauguccaaagugccugacucauaguuagcacuccauaaagguuaacuauuauuagcaucuuugacauucca

SEQ ID NO: 2251315 - RNA, 82 nt, Homo sapiens
ucgcuugaacccuggaggcggagguugcagugagccgagaucgcuuggcgccauugcacuccagccugggcaacaagaguga

SEQ ID NO: 2251316 - RNA, 56 nt, Homo sapiens
cugacuucuugcucauacuagcuguucuauucagaucagcuagugguaggagucgg

SEQ ID NO: 2251317 - RNA, 84 nt, Homo sapiens
cacaucuuucaagugaacaaaaugaggagcaggagcagagaccgagccaugcccuuggugcuguuguucacuuacuuggaugug

SEQ ID NO: 2251318 - RNA, 68 nt, Homo sapiens
ucugagucaucacaaaugaugccuuuuuaagugcuuccaucuucgcuggcaucgcuuugcugaccaga

SEQ ID NO: 2251319 - RNA, 89 nt, Homo sapiens
ggagaaucacuugaaccugggauggagagguugcaaugagccaagguugcgccauugcacuccaucccgggaaacaagagcaaaacucc

SEQ ID NO: 2251320 - RNA, 58 nt, Homo sapiens
cccaggaggcagagcuugcagugagcugagauccugccacugcacuccagucucuggg

SEQ ID NO: 2251321 - RNA, 56 nt, Homo sapiens
aauuuggggggccauagcauggacuguuaugaguuaaauuguggccccuacaaauu

SEQ ID NO: 2251322 - RNA, 55 nt, Homo sapiens
uguguagagaaauauuacuuaugacccauccugggcagugauauucucuuacaua

SEQ ID NO: 2251323 - RNA, 73 nt, Homo sapiens
uuguuccacaaauauuucuugagcaccugguauuugcccagcacugugcuaggugcuaggaagauaggaauaa

SEQ ID NO: 2251324 - RNA, 56 nt, Homo sapiens
gggagcaggucaggggcgcuggcaauugaagucuagcuucucccagaccugcuccc

SEQ ID NO: 2251325 - RNA, 61 nt, Homo sapiens
uaguggugcuuaaauaaggcuuucagaugauucugaugcacauacaguuugagagccacug

SEQ ID NO: 2251326 - RNA, 57 nt, Homo sapiens
acugaaaaggucaaauguauuuugauaaguuaucaaggcacauuugacauuuucagu

SEQ ID NO: 2251327 - RNA, 86 nt, Homo sapiens
ucagauagcagcuccaagaauucugucauguuuauauuugcauucagugagagaagcaggauagaguuuuacucaagcuugccuga

SEQ ID NO: 2251328 - RNA, 63 nt, Homo sapiens
gucugcugccuuuuguucagauaugcccugcccccagagguggaaucuagagaggcaguaggc

SEQ ID NO: 2251329 - RNA, 130 nt, Homo sapiens
ccucggccucccagagugcugggauuacaggcaugagccaccgugccuggccaauaacauauuuuuuaaaaugauaacagccaggcacgguggcucacgccuguaaucccagcacucugggaggcugagg

SEQ ID NO: 2251330 - RNA, 117 nt, Homo sapiens
ggguggugaccugggauucaaucugugaggaaggaaaccugcuagcaggacucucacuuugcugagcauuauuuuuccuucuuccuuuuugcccaauaaauuccauuuuccucaccc

SEQ ID NO: 2251331 - RNA, 86 nt, Homo sapiens
accucacagggcugguaucucacauauucaguagguuuuggggggaaagcuauacuauuuaugaggggagccaagcacaugcaggu

SEQ ID NO: 2251332 - RNA, 74 nt, Homo sapiens
ucuauggauuuuuuucugaauguagaacuagguccucaaauaguuauugagcuaguggucauucaauccuuaga

SEQ ID NO: 2251333 - RNA, 58 nt, Homo sapiens
ggcuggugacccugugguggugacacuagagcccacccauucacggggagcagcagcc

SEQ ID NO: 2251334 - RNA, 62 nt, Homo sapiens
agguaaacauggggacugcuaccaaccccaggagcuagggagguacacuucauguuucaccu

SEQ ID NO: 2251335 - RNA, 102 nt, Homo sapiens
aucuuauuauauauuauuguuaaucucuuacuaugucuaauuuacaaauuaaacuuuaucguagguauguauguaugggagaaaacauaguauauuuaaggu

SEQ ID NO: 2251336 - RNA, 101 nt, Homo sapiens
gggaacagggcaggccaacccugagucaugagucuagaaagcugugucuuugaaaaucuagcaacaaguggccaggcgugguggcucaugccuguaauccc

SEQ ID NO: 2251337 - RNA, 65 nt, Homo sapiens
gccuuuggcauuugaguuuguaggaacaggccuauacauuccuacuguaaaauuccgccacaggu

SEQ ID NO: 2251338 - RNA, 55 nt, Homo sapiens
ccaaguguuuucauuguuccauucccaccuaugagugagaacaugcggcguuugg

SEQ ID NO: 2251339 - RNA, 63 nt, Homo sapiens
gcggguuucgguggaacaguucccugguaacuuaaguguggguuugauucccucuaaacucgc

SEQ ID NO: 2251340 - RNA, 62 nt, Homo sapiens
cauauuggaugugggauaguguacaucaaugaaaaugaacuaauguugcacauaucaauaug

SEQ ID NO: 2251341 - RNA, 64 nt, Homo sapiens
ugguaaguaauugugguuucugccauugaaagucauggcagaaaccacaguuacuuuugcacca

SEQ ID NO: 2251342 - RNA, 100 nt, Homo sapiens
gugucuagaaaugauaccucugagcuagggccuggaauaggggccucuugauucuuacuggugcccuauccugcuguggcugagcugguguccaagaugc

SEQ ID NO: 2251343 - RNA, 76 nt, Homo sapiens
ugguuuuuccauguugauacgugaaguucuaguucauuuauguggauggcugcauggugucccaugggauaaacua

SEQ ID NO: 2251344 - RNA, 82 nt, Homo sapiens
cacaaccuuugaauaaccauguaaaaucuggugaaaguuuaccauaaccagacauucacaauuaaaugugguuauuuuugug

SEQ ID NO: 2251345 - RNA, 81 nt, Homo sapiens
uucagguaucuuuauagcgaugccccacuccugauaccaguuuucuguuaggccauucuugcauugcuauaaauaccugaa

SEQ ID NO: 2251346 - RNA, 55 nt, Homo sapiens
ucuuuguucaggagccaacuccuucaucugagggccuuggagccccagacaaaga

SEQ ID NO: 2251347 - RNA, 80 nt, Homo sapiens
gguaucuuuauagcaaugccccaauccuugguaagaauuuucuguauuaggcuguucaggcacugcuauaaagaaauacc

SEQ ID NO: 2251348 - RNA, 78 nt, Homo sapiens
aaagaaaagccuuuauuugugagacacacauauggaaauauuuauagguauguaauacaaaugaacaggguuugcuuu

SEQ ID NO: 2251349 - RNA, 70 nt, Homo sapiens
auucuguauaauuauagcuguucaggguauuuugguuuugcauggauaucccagugaugauugauaggau

SEQ ID NO: 2251350 - RNA, 64 nt, Homo sapiens
guaaucucagcuacuugggagucagaggcaggagaaucacuagaacccaggaggcagagguugc

SEQ ID NO: 2251351 - RNA, 90 nt, Homo sapiens
cauaaacaaaccacucuagcuccuuugaguagcuucugugaauacuuuccaaaaugcagacuuaaagcagcugcagagaggauguuaaug

SEQ ID NO: 2251352 - RNA, 80 nt, Homo sapiens
ccuuguccucagaaaauggcuuuugcccuaaauggauuuuaaggauggacccaugugccaagagccucagagaggcaagg

SEQ ID NO: 2251353 - RNA, 62 nt, Homo sapiens
uauuuuauguaauauaaguguaguuacuucugcugguuuuugcauugcacuugcaugagaua

SEQ ID NO: 2251354 - RNA, 128 nt, Homo sapiens
guagauugcucucccuuuuuuuuuccucagcuuuuggaggaacuuaagauugcucucccuaauguagguagcccacauccaguccaccaaaggucugaauggaacaaaauggcuaggagggacucuac

SEQ ID NO: 2251355 - RNA, 66 nt, Homo sapiens
cagugggcgcugagcugugaccucucucugcaggacugacagcuauucaucaguuggugcucgcug

SEQ ID NO: 2251356 - RNA, 58 nt, Homo sapiens
gcccaggguagagugcagugguguaaucacagcucaccacaaccuccauauccugggu

SEQ ID NO: 2251357 - RNA, 75 nt, Homo sapiens
accuaauguacauggaaugaaauucaaaaggaauaauuuaaaugauuaggaaugguauuccauguguuuugaggu

SEQ ID NO: 2251358 - RNA, 62 nt, Homo sapiens
agaaaucaguggccguggucauuugcugucauucugcaauauucuaugaccaugugauuuuu

SEQ ID NO: 2251359 - RNA, 67 nt, Homo sapiens
aagguuaagugguagguggugcccaagagaacugcauuuccuuggacagagcaucuuuuacuuccuu

SEQ ID NO: 2251360 - RNA, 115 nt, Homo sapiens
caaugucgcugggcguguacacacacccucugugauguuguuccuaguauccaaagguagagacgaugauauuacuggccauaucgcagggggcguacacccuucugugauauug

SEQ ID NO: 2251361 - RNA, 65 nt, Homo sapiens
gcuuaagggaaugugguagcugguuugaucgucuauccagaccacuuaaauuuuccuauaucagc

SEQ ID NO: 2251362 - RNA, 73 nt, Homo sapiens
uacuuuaaucuuuuuucaguuuuccagguagccggucacuaugagccaccaaggaaauugagaccauaaagug

SEQ ID NO: 2251363 - RNA, 72 nt, Homo sapiens
cauugcauugugaucuucccagauuuagggcagagacagggcagucagucugggaaggcacuuaguggagug

SEQ ID NO: 2251364 - RNA, 59 nt, Homo sapiens
cagaaggagcuaucuggcgcaucuccuuggaucuagcagugcuuguagccucacuucug

SEQ ID NO: 2251365 - RNA, 107 nt, Homo sapiens
uuugcauaauguuucuuaaagucaggaguaguaggaaguuuuguagucaaacagacuuagcuuuggauaccugcuguuccacaugcugacuuuaagacacuggcaga

SEQ ID NO: 2251366 - RNA, 69 nt, Homo sapiens
ggcaggaggaugugggaggcgaaugacuacuggacaugagagccaguucccuuagccaaauccccagcc

SEQ ID NO: 2251367 - RNA, 69 nt, Homo sapiens
gagcuaguguaauauuuugggggugcuauaaaaacuugucuugucauauuaccagaauuacuuuaguuc

SEQ ID NO: 2251368 - RNA, 101 nt, Homo sapiens
gucuauuaggaaaauaaaggaauaaagcauggcuacuccauaggcagagcagcuccaaggccugcugguuggcuauuuuuaugguuauuucuugauuagau

SEQ ID NO: 2251369 - RNA, 72 nt, Homo sapiens
aguuugaagucagguagucugaugccuccagcuguguucuuuuugcaugggacugucuuggcuauacaggcu

SEQ ID NO: 2251370 - RNA, 79 nt, Homo sapiens
gccuuccauucacugugugacccugggccagacacuuccccucucugagccucaguuuccacggcuguaagaugagggu

SEQ ID NO: 2251371 - RNA, 105 nt, Homo sapiens
accagaaugcaguaucccuaaagccucugcagucccugcgauugugggauccugacuaugucaggauuuuggcuuugcaggguguggcaaggugaagggucuggu

SEQ ID NO: 2251372 - RNA, 63 nt, Homo sapiens
uugcugauuugaguuuccuguagauucuggauaugagcacuuuacuggagauacagucugcaa

SEQ ID NO: 2251373 - RNA, 71 nt, Homo sapiens
cgcucucuugccuaggcuggagugcaguggugcgaucucggcucacugcaaucuccucccagguucaagcg

SEQ ID NO: 2251374 - RNA, 122 nt, Homo sapiens
acaauuauguaaaagauauauuaacaaggacugcagaguauaaagauaauuguggauaacuugauuuuuuuaagguuguauuuaauauacuguuauuucuuuuuuuaauuuuuauuuuuugu

SEQ ID NO: 2251375 - RNA, 82 nt, Homo sapiens
aguuauaggguacauguacacaacaugcagguuuguuacauauguauacuugugccauguuggugugcugcacccauuaacu

SEQ ID NO: 2251376 - RNA, 64 nt, Homo sapiens
uugcuuuguuacugcaguuuccacucuuucagcuccagcugggcugacugcagcugcagggcag

SEQ ID NO: 2251377 - RNA, 96 nt, Homo sapiens
gaaccacacagagugcaauuaugugugauacuaauggaaaaggaaaaagcaaucuuuugggggugauucacacagugaguaauugacucuggguuu

SEQ ID NO: 2251378 - RNA, 84 nt, Homo sapiens
uuaguucauuggacaugggcuaguucauuaguucuuuaacacauuuauaagagcugauuuuaaguccuuguccagaaauucuaa

SEQ ID NO: 2251379 - RNA, 130 nt, Homo sapiens
cauucgugcaauacuguucuaagauuugaaaguccuucguuuaugggcaauuuaagauaaaaauaauagcaccuucuauugccuaugauugagguacuaauauugauuuaaaagaaaagccuuguaaaug

SEQ ID NO: 2251380 - RNA, 83 nt, Homo sapiens
agaaagagcuuacgagcaagcgcacuuguguguguguagauaugaacuaaugcauacagaagguguuuucaugagggauuucu

SEQ ID NO: 2251381 - RNA, 92 nt, Homo sapiens
aaaagguaaaaguaauugggaauaugucaccccaugggauuuaaguggccaacuagcucuuccuuggugacauuucuugucuugugccuuuu

SEQ ID NO: 2251382 - RNA, 70 nt, Homo sapiens
ugcacuuacuuuuaaggggccuugauuuaggagucugguauuaccuaaaugcucuuuaaaagugcuugca

SEQ ID NO: 2251383 - RNA, 67 nt, Homo sapiens
auugugugaaccuucuagaaucagacauauuugcaaaagauugucauugcuuaaggguucaugcaau

SEQ ID NO: 2251384 - RNA, 80 nt, Homo sapiens
ucuguuucuugaaaagucuugucaagguucccagucugaagacaaauaugugguccucugaaggcuuuucacuuaauaga

SEQ ID NO: 2251385 - RNA, 59 nt, Homo sapiens
gggccucuucucagggauacucacaaaauggcagacugcuuuccugagaacaagggcuu

SEQ ID NO: 2251386 - RNA, 78 nt, Homo sapiens
gauuuuaucuuugguugcacugcagguguucagcucuccagauucgccacaucuguuaccaaccgauagucaagaauc

SEQ ID NO: 2251387 - RNA, 75 nt, Homo sapiens
uagaacacuguuccauagugagcagucaauguaagcagaaaguguacguaauugcugcuguggcucaguaaucua

SEQ ID NO: 2251388 - RNA, 55 nt, Homo sapiens
uugagauggagccucacucugccacccaggcuggagugcaguggcucgaucucag

SEQ ID NO: 2251389 - RNA, 66 nt, Homo sapiens
guucaguuugugaucauugucaaauaguguuuauuaagcauuuaccuauguguuacaaugcuggau

SEQ ID NO: 2251390 - RNA, 61 nt, Homo sapiens
gaucuuaugugugguggcauucacccuggcauggugggucaagaugcaaugcacugagguc

SEQ ID NO: 2251391 - RNA, 74 nt, Homo sapiens
ucuuuauuuuaugaauaccaccauuagguugcauuugcgacagaauuuuccugagguagaguuuauauugaaga

SEQ ID NO: 2251392 - RNA, 62 nt, Homo sapiens
ugagauuugaggggccaggggcagaaugauauaguuuggauguuucuccccuauaaaucuca

SEQ ID NO: 2251393 - RNA, 57 nt, Homo sapiens
augagaucugugaacaccugucaaaagccuaaggagaggugagaauuuagauuucau

SEQ ID NO: 2251394 - RNA, 80 nt, Homo sapiens
guuguaagaucaauaaguagaaugauggucaaaagcuacuuguggcuauuggaaauuccugcuuaaaccugacuaauaac

SEQ ID NO: 2251395 - RNA, 83 nt, Homo sapiens
uuguuguguuuaaccucccccaccugaggacagucuuauuuuaaaauaaggcuuuuguucagcguggguguauuuuauaauaa

SEQ ID NO: 2251396 - RNA, 76 nt, Homo sapiens
uccugaaaaucccagguguccuggaguugguacugucagcaucuucaaacauccccaccagggacuuucuauaggg

SEQ ID NO: 2251397 - RNA, 80 nt, Homo sapiens
gcagaaaggagaaaaagaaauagcuaguauaggacuacauagucacgugcuuucuuuucauuuagaauuuccucuuuugc

SEQ ID NO: 2251398 - RNA, 57 nt, Homo sapiens
ucugccacugucauugugugauuggugcugcacaccaaccauaggggacaguguagg

SEQ ID NO: 2251399 - RNA, 80 nt, Homo sapiens
gccuuuguccuaaugcagggcauggacuauguugacaaauuagugaacacagccugccucugccacagcgauccagaggu

SEQ ID NO: 2251400 - RNA, 100 nt, Homo sapiens
ugcaucacuguagaagacugcauuugacagagaaaagugugacuuauaaauuucugaaaguugucaucuuuucuguugaugguauuuauucacaaaugca

SEQ ID NO: 2251401 - RNA, 77 nt, Homo sapiens
auguggcuuuugucuuugguucuguuuauaugcuggauuacguuuauugauuugcauauguugaaccagccuuacau

SEQ ID NO: 2251402 - RNA, 77 nt, Homo sapiens
uauugguggcagauaaguuuuugaugugcugguagauucguuuugccaguauuuuauuaagaauuuuugcaucaaug

SEQ ID NO: 2251403 - RNA, 66 nt, Homo sapiens
uauugacguguaguaaacagucagaaaacuuagcuaaaaacaauuugacauuauuucaugucagua

SEQ ID NO: 2251404 - RNA, 65 nt, Homo sapiens
guggugagauggaguuggugucuuuugguuuuauuaaccuagggacuauuuacccaucucacuau

SEQ ID NO: 2251405 - RNA, 55 nt, Homo sapiens
gacaauauuaagagaagacagcccauguuaauggauugaaagcuuuaauauuguu

SEQ ID NO: 2251406 - RNA, 97 nt, Homo sapiens
uauauuugacagguuucuauaugggucuaauuauucugauauuuuugguccuucaaaagugaucauuugaauugaugaugugguauuugucuauaua

SEQ ID NO: 2251407 - RNA, 62 nt, Homo sapiens
cagaaaagcacaagcuuucaacuuagcaccauugucaauaagccuaggucugugcucuucug

SEQ ID NO: 2251408 - RNA, 99 nt, Homo sapiens
auugagcaggggcuguggauagaaauuuccuguaggggcuugcgaaggcaucuucacugguccuuuauaggaacccucuaugcauuucccuuugccagu

SEQ ID NO: 2251409 - RNA, 81 nt, Homo sapiens
agcuuuuccuaugaaagucaauccccaaguguccccuaaaacaugaggacaggggaauuuacugucauuaagcagagagcu

SEQ ID NO: 2251410 - RNA, 80 nt, Homo sapiens
cuacuggacgucucccuaccugagccgagccaugcgggaugccggguggcugcuggggcagggaggacaggugcaggugg

SEQ ID NO: 2251411 - RNA, 67 nt, Homo sapiens
guuaaugugagugcucauuuucaucguaccccgugguacaucauauguggaaauggaauuuacuaau

SEQ ID NO: 2251412 - RNA, 58 nt, Homo sapiens
uggagaugcacgagcagguggagcagcugaagcagagcauccaccgcgugcaccucua

SEQ ID NO: 2251413 - RNA, 67 nt, Homo sapiens
gauguauuaucuuugugguaucguguugaauucauuuagcugguauuuugucaaggauauuuacauc

SEQ ID NO: 2251414 - RNA, 83 nt, Homo sapiens
ucguauggucaugucauguuuaacuucuugaggaacuucuauguugucuuccauagcaguugaaccauuucauccauauacga

SEQ ID NO: 2251415 - RNA, 64 nt, Homo sapiens
guguuugugugugauuauaaaaggucagacagaucuggaaucuuugcucuaucacugcaaacau

SEQ ID NO: 2251416 - RNA, 79 nt, Homo sapiens
cuauauuuauacuacuauaaagagguaguuguagcaaucugguccuaaauuauugaucucuauaguaguauagagguag

SEQ ID NO: 2251417 - RNA, 79 nt, Homo sapiens
uaguuaguuuuucugagauggagucuuuuucugucacccaggcucuggagugcaguggcgccaucucagcucauagcua

SEQ ID NO: 2251418 - RNA, 130 nt, Homo sapiens
uuuguuuuguuuuguugagauggaggucuuacucuguugcccagguugaagugcagcggugcaauaauagcucacugcagcacugaacuucugggcucaagugauccucuugccucagccucccaaaaug

SEQ ID NO: 2251419 - RNA, 77 nt, Homo sapiens
uauguucagcuaaggauggcucccagauaucuaguuuugauacccugauaugugauaagaguuaucuuuugggcaug

SEQ ID NO: 2251420 - RNA, 66 nt, Homo sapiens
acucuuugugaggagugaacuauuucugauucccuuuuagucaaagguauagcuuuucaagagggu

SEQ ID NO: 2251421 - RNA, 91 nt, Homo sapiens
cuugaugcuagaugacagcgaaaaaauauuuaccaaguucagagggaaagacuugugacuuuagaauuuuauccagauuaucaguaugaag

SEQ ID NO: 2251422 - RNA, 59 nt, Homo sapiens
agacccauagaagcgagcuugugcgguccacuucaccacaagaucggaucuacggguuu

SEQ ID NO: 2251423 - RNA, 67 nt, Homo sapiens
uuccuaucuggccuagaacaauuaauuagcuguaagucuuguugacuaagucccuuggccauaggga

SEQ ID NO: 2251424 - RNA, 84 nt, Homo sapiens
ugaguuuggaaaauuaucaucugaagauugcuguucaacuuuuggagagugauauucagaugcuuugaagacuuccaauauuca

SEQ ID NO: 2251425 - RNA, 57 nt, Homo sapiens
gggggagugugguacccagcauuuugucccacagagggguucccauggcacucccuc

SEQ ID NO: 2251426 - RNA, 69 nt, Homo sapiens
guuuugugagguguuuaagcauaggaucugccaaucucuucagccuugugcuucaucaccuagcagaac

SEQ ID NO: 2251427 - RNA, 71 nt, Homo sapiens
caaagaagagacccagagccagcaaaugagacaugaguuuguuuguuuguuugagauggagucucacuuug

SEQ ID NO: 2251428 - RNA, 122 nt, Homo sapiens
cccaauucacucuuuucuuuuugauuuuagaugggaaauguaaagucauaagaucgauagguugacugugacaacuauguuuacuuacagagagaacaggaaaugagaaugggugauauggg

SEQ ID NO: 2251429 - RNA, 67 nt, Homo sapiens
aaaucagugcuuuaucaaguccuccaggugauucugauucauggugaaguuugaaaagcacugauuu

SEQ ID NO: 2251430 - RNA, 66 nt, Homo sapiens
uuugugacuugcuucucagaauacaacaaagguaauggaauaucacuucugagauuagguuacaaa

SEQ ID NO: 2251431 - RNA, 77 nt, Homo sapiens
ucugugucacauguaaguuugguguucugaagccagugaauuuaugcgguugaacaauagauucauaucaucacaga

SEQ ID NO: 2251432 - RNA, 56 nt, Homo sapiens
uuugguucuguuuauaugcuggauuacauuuaucgauuugcauauguugaaccagg

SEQ ID NO: 2251433 - RNA, 68 nt, Homo sapiens
augucuucuguaggucaacaaguaugauaugaaccacagguguuaugcuuauugguguacgguaguau

SEQ ID NO: 2251434 - RNA, 66 nt, Homo sapiens
ggauacauucugagaaaugcaucauuaggcaauuuugucauugugugaacaucauagaguguauuu

SEQ ID NO: 2251435 - RNA, 82 nt, Homo sapiens
guggcacacaaauaguguuuccuucuuuacauguucaaaagagaacaaaggauucuaauggaaaugcuaaauguuuugccac

SEQ ID NO: 2251436 - RNA, 70 nt, Homo sapiens
gugauuaucccaaauagcugagacuacaggugugcaccgccaccugugguuacagucugucucuguucau

SEQ ID NO: 2251437 - RNA, 112 nt, Homo sapiens
acgugauggucucugggugguucagcuucuuauauggcggcucacagaguguuuccagacaggagguagaagcugccagucuuguaaggccugagcccagaaacuggcaugu

SEQ ID NO: 2251438 - RNA, 68 nt, Homo sapiens
cccuaucuccaaauacaucacauucugagauacugagguuaagacuucaugugaauuauuuggugggg

SEQ ID NO: 2251439 - RNA, 57 nt, Homo sapiens
cucaccuugugauccaccggccucggccuccuaaagugcugggauuacaggugugag

SEQ ID NO: 2251440 - RNA, 69 nt, Homo sapiens
gggggugaguggguucucucuuuauuaguucccaugagagcugguuguuacaaagagccuggcaccucc

SEQ ID NO: 2251441 - RNA, 72 nt, Homo sapiens
gggaaguuuuacuuccggauugcugggguaucgauaagggaauuaaagcaaccagaggagaugaggcugccc

SEQ ID NO: 2251442 - RNA, 62 nt, Homo sapiens
uuguagacagcacguaguugagucauguuuuuaaaucgacuuugcuaaucucugucuuacag

SEQ ID NO: 2251443 - RNA, 64 nt, Homo sapiens
guuauaucagccauuucuaguuacuagaaaucucuagauauaacuaguagauggcugacauaau

SEQ ID NO: 2251444 - RNA, 56 nt, Homo sapiens
gcuuucuccacuaauguagcagauaucaaaaguucuggauuacaggugcugagagu

SEQ ID NO: 2251445 - RNA, 94 nt, Homo sapiens
gaggcaggagaaucgcuugaacccaggaggcagagguugcagugagccgagauugugccacugcacucugggcaacagagcgagauuccgucuc

SEQ ID NO: 2251446 - RNA, 78 nt, Homo sapiens
aauaacacuugcaguugguauuacagaaauuaguucuuaacaguggcuucauuuucguaaugcuuuguaaguguuauu

SEQ ID NO: 2251447 - RNA, 63 nt, Homo sapiens
gaucaaacugcaaggcagcagcaaggcuaggggaggggugccugccauugcccaaguuugauu

SEQ ID NO: 2251448 - RNA, 80 nt, Homo sapiens
augagaccagcagaaaaccuguccaacuagccccaguuaagccauacaauagugauagauaggcaaauuuguuguuuuau

SEQ ID NO: 2251449 - RNA, 82 nt, Homo sapiens
auucuuuuguucucuauuguacauguuauagauuuuuaaguugucuggaagucaagaugcauaugcaaguauacaaaagggu

SEQ ID NO: 2251450 - RNA, 70 nt, Homo sapiens
gugggacggauaugccuaguauuaauuacagcaauguaggaaugcuaaaauaggaugcugcagaaccuac

SEQ ID NO: 2251451 - RNA, 76 nt, Homo sapiens
ggaggggaagaggagguguucccugauaauuauaagguuucauggagaaucuucuuacuaguauuauuucuucuuu

SEQ ID NO: 2251452 - RNA, 77 nt, Homo sapiens
cagauuuuucaguggguucuuuaggacucugcgaugaaucuucuugcaaggugcucgaagggcucacuggaucucug

SEQ ID NO: 2251453 - RNA, 70 nt, Homo sapiens
uuaaaucugcaaagcugggcugagacacaggaaacuggaaaaugucuccacuaauuugcaaaagguuuga

SEQ ID NO: 2251454 - RNA, 91 nt, Homo sapiens
auuacuuugcccacuguuaaauuuguuuuaauucauuuauaucagguuccacguuaggacucaggauuugauagauggggagucaaguaau

SEQ ID NO: 2251455 - RNA, 57 nt, Homo sapiens
ucuugccuuugucuucaaaggcucugccaaugugaaguacaggagagagaggcaaga

SEQ ID NO: 2251456 - RNA, 62 nt, Homo sapiens
cgacuggccuagacuaguguuugaccaaacaacugacuacuacuauuagucuggccaaguug

SEQ ID NO: 2251457 - RNA, 96 nt, Homo sapiens
ucccagucauacuccugacacaguguuccagcuauuugaaucagacaggcacuucuuuucaucugcaggaaugcugauguccuguguagaauggga

SEQ ID NO: 2251458 - RNA, 66 nt, Homo sapiens
uaaaauaguuuauguagcaaagccucaaaaugcagucucuaagggccaugcuaugagauuauuuua

SEQ ID NO: 2251459 - RNA, 55 nt, Homo sapiens
uugagauggagucucacuccuuugcccaggcuggagugcaguggcgccaucucag

SEQ ID NO: 2251460 - RNA, 103 nt, Homo sapiens
cccaacugcagcaguucagagaaugucuuuuuuaaccauuugauacccauuugguagaauauaguauauuggagaugugucuugaaauuggaugccauuuggg

SEQ ID NO: 2251461 - RNA, 58 nt, Homo sapiens
ucuccacuuaauucagaugcugggaaaauauuuccuuggcagaugggugagcuggaga

SEQ ID NO: 2251462 - RNA, 75 nt, Homo sapiens
agcaaccaagauaucccuguauaagugaauguauaaacugugguacauuuagaugauaggauauuauugagugcu

SEQ ID NO: 2251463 - RNA, 57 nt, Homo sapiens
cuaggcacgccugggucuccaggacugcugaagcacaagacccgagggguggccugg

SEQ ID NO: 2251464 - RNA, 55 nt, Homo sapiens
uauggcugcuuucacacuacaaccauggaguuguguaguugugacagagaccaua

SEQ ID NO: 2251465 - RNA, 65 nt, Homo sapiens
uuugagaugcauacucaaauuaaguauauuuauuugaaaugcauauguugagaugcauauucaaa

SEQ ID NO: 2251466 - RNA, 76 nt, Homo sapiens
agguuggugccaaaguaauuacgguuuuggccauuauguucaaugacaacaaccacaauuacuuuugcaccaaccu

SEQ ID NO: 2251467 - RNA, 80 nt, Homo sapiens
gggugcggcgggagcugcaggagcugcgggcaucucaccugagcaguucaggcuccgugccagcuccguggccaucaccu

SEQ ID NO: 2251468 - RNA, 73 nt, Homo sapiens
ugcaauuccaugugaagagaccaccaaacaggcuuugugugagcagcauggcuguuuauuucaccugggugca

SEQ ID NO: 2251469 - RNA, 57 nt, Homo sapiens
cccaucuuugugguuuuaucuaccuuuggucuuugaucauggugacguacagauggg

SEQ ID NO: 2251470 - RNA, 63 nt, Homo sapiens
cuauguguccauauguucucaucauuuggcucccacuuacaagugagaacaugugguauuugg

SEQ ID NO: 2251471 - RNA, 112 nt, Homo sapiens
ccuggugucugagggguuuuguccacagcuuguccugcuacauuucuugguucucugacugggaagcgaggugauuagcagacagucaaggcagccccuuagguggcucagg

SEQ ID NO: 2251472 - RNA, 60 nt, Homo sapiens
cagagcauggaggacugcaggccuggcuggcuucagugagggaugcguacccuaugccug

SEQ ID NO: 2251473 - RNA, 56 nt, Homo sapiens
cuauuaaacacuacugugcacuuacuuauguucuacaugggcaguguguuuaauag

SEQ ID NO: 2251474 - RNA, 130 nt, Homo sapiens
uuuugcuuacuauagcuuuguaguauaguuugaaauugaguagugugaugcaugucucuagcuuuguucuuuuugcucaagauugcuauugcuauucagagucuuuuguaguucaaagaaaagcccagga

SEQ ID NO: 2251475 - RNA, 73 nt, Homo sapiens
gugauuuguugugcuuaagccuauugauugccuguaaucccagcacaaugggaggccgaggcaggcagaucac

SEQ ID NO: 2251476 - RNA, 62 nt, Homo sapiens
ccucaguuucccuuuugcagugaggauaggaauaacacccaucucacaggguugacuugagg

SEQ ID NO: 2251477 - RNA, 55 nt, Homo sapiens
aauacccuuguuaauuuacugucuuaaugauagucugauauugacaguggguguu

SEQ ID NO: 2251478 - RNA, 61 nt, Homo sapiens
guggguaaaucucuguucgaggcuuucagcuucgaaggcugugagaccccugauuucccac

SEQ ID NO: 2251479 - RNA, 66 nt, Homo sapiens
cagauuaugcaacgguaugggacaaggccaacaagccauguguccugaagcuuuguuauguaucug

SEQ ID NO: 2251480 - RNA, 55 nt, Homo sapiens
caauaucacaggggguguacaccaccccuguuuguaaauguccccugugauauug

SEQ ID NO: 2251481 - RNA, 101 nt, Homo sapiens
ucauggaccacauacauuuggacaguuugguaucccucaccaucugaacucaggaacuguacagauucagagagggagggauaccuaaaggugugucauga

SEQ ID NO: 2251482 - RNA, 84 nt, Homo sapiens
ugugauuauaggacauauuuuaauaacucaaguagaaaaauguaaaagaauuuagcugagaguugaugaaauaugguaaucaca

SEQ ID NO: 2251483 - RNA, 59 nt, Homo sapiens
gcaucuucuaaugaguauaguagcugagagaagauagcuauuugcauucagaggcaugu

SEQ ID NO: 2251484 - RNA, 64 nt, Homo sapiens
uauaaauggauuaaguucacuugcuuagaaacacaauaagcagguuggaaaaaaucuaccuaua

SEQ ID NO: 2251485 - RNA, 60 nt, Homo sapiens
ucagcacauucaaggccugccugacccuagaaaaccaggaggccaaaagacauguguuga

SEQ ID NO: 2251486 - RNA, 55 nt, Homo sapiens
uugagauggagucucacucugucacccaagcuggagugcaguagugccaucucag

SEQ ID NO: 2251487 - RNA, 68 nt, Homo sapiens
ggguacaugugcacaacgugcagguuuguuacauauguauacauaugacauguuggugugcugcaccc

SEQ ID NO: 2251488 - RNA, 59 nt, Homo sapiens
ugccaagauuucaggaauuaagauauuaacuagccucauagauccugacuuuuugagca

SEQ ID NO: 2251489 - RNA, 69 nt, Homo sapiens
aucaucaucuccaauguuugugucuucacuuggcgaucuuugaagacauuuacaugggagacccuugau

SEQ ID NO: 2251490 - RNA, 78 nt, Homo sapiens
cucuuauggcuuugugccucagcauucuuugcauucagcuggaaaaggugaaagaggcuguaggauaaugccugagag

SEQ ID NO: 2251491 - RNA, 58 nt, Homo sapiens
uacuuugcaguguuggugauauaacgaaauaacaugugugccacuguucuguaaagug

SEQ ID NO: 2251492 - RNA, 57 nt, Homo sapiens
gugccgggacagugguaccuuagaugggaaggccccaguaaugccacugccuggcau

SEQ ID NO: 2251493 - RNA, 129 nt, Homo sapiens
gggggugacccacacacguuuaauuugcacugacguuguuuguuuuggugucaugcgugaagccuuacuuguucucagucauguuuaccagacguauuaucaugcauuuuuguuuucugucucuucccc

SEQ ID NO: 2251494 - RNA, 58 nt, Homo sapiens
cugggaggcagaaguugcagugaguugagauugcgccacugcacuccaaccucaacag

SEQ ID NO: 2251495 - RNA, 80 nt, Homo sapiens
cgauguugcuagguagaguguaaaccacauagugagagugaaaaauucuuuggcuacuugauauucugaagcaaauauug

SEQ ID NO: 2251496 - RNA, 77 nt, Homo sapiens
ucacuugaacccgggaggaggaaguugcagugagccaagaucgcgccauugcacuccagccugggcaacaagaguga

SEQ ID NO: 2251497 - RNA, 60 nt, Homo sapiens
cuccugaccuggugguccacccgccuuggccucccaaggugcugggauuacaggcaugag

SEQ ID NO: 2251498 - RNA, 56 nt, Homo sapiens
gagagagagagagagagagagagcacaugugugcaagcucuuuggugucucuucuu

SEQ ID NO: 2251499 - RNA, 58 nt, Homo sapiens
gugcacaacacgcagguuuguuacauauguauacaugugacauguugguuugcugcac

SEQ ID NO: 2251500 - RNA, 59 nt, Homo sapiens
ccguuugguacuuagagauucucuuuaugcacuuaaaaggcaucauuaguaccaagugg

SEQ ID NO: 2251501 - RNA, 59 nt, Homo sapiens
ugccuaagcagaaguuugcugcaggggcagggcccucauggagaacaucugcuagggca

SEQ ID NO: 2251502 - RNA, 104 nt, Homo sapiens
gcaugcugaccagcccacccacagcucauugcuguccuggaggaagguuuggggcccucugcggggcagcaguggcuggggagaauugagccaugcagacaugc

SEQ ID NO: 2251503 - RNA, 128 nt, Homo sapiens
ugguggagggcuucuacggcuguuacuucucagguacuucugggcugagcagagcaggcucuggcagccugagcaaguccucaagcaaagggaagcagcuaacagcaggggaggcagagccuugacca

SEQ ID NO: 2251504 - RNA, 73 nt, Homo sapiens
gcacaguucaggcuuuuccacacauggguucaggauuccaaagagcugcaaaagugggcaagccucauugugc

SEQ ID NO: 2251505 - RNA, 63 nt, Homo sapiens
gcuguuuuucugagugaauacauaauauuaauaagaguaaacauuucauacagugagagcagc

SEQ ID NO: 2251506 - RNA, 123 nt, Homo sapiens
uuucagucuugaggucucucccucuugcagguggcuauagacucuagcccuuacaagacuucaggugauuuggucauggauguuuauaguacaccuuucagggggugccuuuuuauacuggag

SEQ ID NO: 2251507 - RNA, 56 nt, Homo sapiens
ucuuugguaauggaugucugauuucuaguuggagacaaggcaacccauaguaaaga

SEQ ID NO: 2251508 - RNA, 92 nt, Homo sapiens
gugcuacuugagcagccagucucuagaaugcugucaacagagugcccacagaauucucagaacugggagcuuaauuauacccaucauagcac

SEQ ID NO: 2251509 - RNA, 64 nt, Homo sapiens
cagcuuuauugagguauaauugcuaugcagaaaacugcacauaauuaaugccuacaacuugcug

SEQ ID NO: 2251510 - RNA, 56 nt, Homo sapiens
cacaugugugcaggugugugugugguugccccaguguacacguaugagcacaugug

SEQ ID NO: 2251511 - RNA, 68 nt, Homo sapiens
gucugaaaaacauuacuugucacuagaagcaaaauugcuuuuagcagccaugacaaagaugggcaggc

SEQ ID NO: 2251512 - RNA, 70 nt, Homo sapiens
uuucuacuuucgguuaucuagcuuuaugacggcucuguggcacucauacagcuagauaaccaaagagaga

SEQ ID NO: 2251513 - RNA, 60 nt, Homo sapiens
aauauagcuauguacauguccauacagcaagaagacucugacaugugccaaugcuguauu

SEQ ID NO: 2251514 - RNA, 63 nt, Homo sapiens
uugcagagccccugcaagggucucagggacaccaucucccaccauacccccagggcucugcag

SEQ ID NO: 2251515 - RNA, 55 nt, Homo sapiens
gucacugggugcugcgccugucacuuugaauuguugagaggcaagggcucaugac

SEQ ID NO: 2251516 - RNA, 78 nt, Homo sapiens
uauuaauaaauuaucuaguaaugaaaaaugugagaggaaccauacucuuacaucaggcuugugaugauuacuuugaua

SEQ ID NO: 2251517 - RNA, 85 nt, Homo sapiens
gggcuuuaaauuaagguguccuggcucuagagucugugcucuuaacauauacuguacugucuggggcagucuaaguuuacagccc

SEQ ID NO: 2251518 - RNA, 62 nt, Homo sapiens
gcuuauuuauuuucucguugcucacagcucuggagcugucaucauuugagagaagaaagagc

SEQ ID NO: 2251519 - RNA, 82 nt, Homo sapiens
aaaugagugagaauaugugaaguuuaucuuuuuaugccuagcuuauuucacuuagcauaaugacuuccaguuccacucauuu

SEQ ID NO: 2251520 - RNA, 74 nt, Homo sapiens
uugaguaggucaccucaggaaauacugagcuucucaacauugaagcuucaaguguauaugagaugaccacuugg

SEQ ID NO: 2251521 - RNA, 80 nt, Homo sapiens
cuugagcccuggaggcugaggcuguagugugcugugaucaugccacugcacuccagccuaagaggcagaacgauaucaag

SEQ ID NO: 2251522 - RNA, 120 nt, Homo sapiens
caugcaucucauuuguaccuuucuccuaucaaguguauggauuuucagauucuuaucuuuuagaaggaugagcugcucaaucuguggucugugauggaaggcagguagggugaguucaug

SEQ ID NO: 2251523 - RNA, 59 nt, Homo sapiens
ggcuaacacagggcaagucaggcuccauuccuuugagagucaacugguucuguguaguc

SEQ ID NO: 2251524 - RNA, 130 nt, Homo sapiens
aggcacccgccaccacaccuggcuaauuuuuguguuuuuaguagggaagggguuucacaaggcuaggcgugguggcucacccaacucuacuaaaaauacaaaaauuagccaggcgugauggcaugcgcuu

SEQ ID NO: 2251525 - RNA, 64 nt, Homo sapiens
uaauaucgaauuucauccugugguaaaauaaaauuaggcuaccacaggguaaaguuagauauua

SEQ ID NO: 2251526 - RNA, 58 nt, Homo sapiens
ggaaaaugccagagguauugucagguugugaaacuguagcugcguuuaggcauuuucc

SEQ ID NO: 2251527 - RNA, 63 nt, Homo sapiens
cuuagaguaccugcuauuuaaaaaaaucauccaagaauuugaaauuuaaggcaggacuuuaag

SEQ ID NO: 2251528 - RNA, 66 nt, Homo sapiens
uugagccuaugugugucuuugcucaugagaugggucuccugaauacagcacacccaugggucuuga

SEQ ID NO: 2251529 - RNA, 70 nt, Homo sapiens
ggaggcugccagcuuacauuaucgggccaguggcugacauugucagcuagcauucaaaugugcagccuuc

SEQ ID NO: 2251530 - RNA, 72 nt, Homo sapiens
cuggccccagcagguauuagagagccugaaagauuaccucuguuucucuccccuacucuaaaucugcacuag

SEQ ID NO: 2251531 - RNA, 81 nt, Homo sapiens
ucuuuuucuuccguagcagcuacuaaguugcuguguugacucacaugccuaacucuagcugcuaaaucauguugagagaga

SEQ ID NO: 2251532 - RNA, 63 nt, Homo sapiens
ugaaauguccaguguuccucagaagaaagguacagcuucuucagaggagcuauggaauaucca

SEQ ID NO: 2251533 - RNA, 77 nt, Homo sapiens
uuuuguuuuauagguccugugagauguaugcauuaaagagguucuguuuugauguguuuccaggauuuguuucaaga

SEQ ID NO: 2251534 - RNA, 130 nt, Homo sapiens
gugucagaaucaccuggugggcuuguuaaagaacagauugcugggccccagccccagaguuugauucugcaguucuaggguggggccagauaauuugcuuuucuaacaaguucuaugggaaugcugaugc

SEQ ID NO: 2251535 - RNA, 60 nt, Homo sapiens
augccacccaacauguucacauguucugagaauuaaaauaugaacacuuuugggaggcau

SEQ ID NO: 2251536 - RNA, 69 nt, Homo sapiens
gcagagugagcaauugauacuugaaguagacaguggauuguccccaacuucaaauuguuuuaacuuugu

SEQ ID NO: 2251537 - RNA, 85 nt, Homo sapiens
agggugguuuugccaaacaaaggugcaguuggaugaaaaaccaguguaaauauuugcacauuuuuucuggcagaaauccuacucu

SEQ ID NO: 2251538 - RNA, 69 nt, Homo sapiens
gagacucuccuucaguccaguggguuuugaggcagagccucagaauacagaacugaggaaucaugucuc

SEQ ID NO: 2251539 - RNA, 55 nt, Homo sapiens
gcagucccuaccagagucaguauacuucuuguucauauuacuguuagaggacugc

SEQ ID NO: 2251540 - RNA, 63 nt, Homo sapiens
guaggcacuggcucagcuuaucacuuugguauugugagagggaagagcauggccauguccuac

SEQ ID NO: 2251541 - RNA, 77 nt, Homo sapiens
uggauuuccuucagucucuucuaugacuucuaagacuuauauuucauagaagaacauagggugacugaaaccaucca

SEQ ID NO: 2251542 - RNA, 71 nt, Homo sapiens
gggagaaaaccggguguuuuguucucucagaccuaaagauaaauuugcaacaaacaagacaacucucuccc

SEQ ID NO: 2251543 - RNA, 56 nt, Homo sapiens
guuauugcaguauagaggucuaagcaccaauucuuagaucauauacuugccaugac

SEQ ID NO: 2251544 - RNA, 86 nt, Homo sapiens
uaaguucuaggguacaugugcacaacgugcaaguuuguuacauauguauacaugcgccauguuggugugcugcacccguuaacuug

SEQ ID NO: 2251545 - RNA, 71 nt, Homo sapiens
cuucacaugaguuucccugcacuguuguucuuacuauugugucuaguggaacacaucuaaggaagcagaag

SEQ ID NO: 2251546 - RNA, 129 nt, Homo sapiens
uaaauagcagauuguagugucugguuugguuuggacaguagugcuuucuaucauauuguugugugcaaugguaauuuguucuacuggccaaagccucuuucagcagugccuugccaucaugcuuaaaag

SEQ ID NO: 2251547 - RNA, 74 nt, Homo sapiens
cuuuuuagagaagacguuugucucugguccacagggcuguggacagagacuaaauguuguuugucucuagaaag

SEQ ID NO: 2251548 - RNA, 60 nt, Homo sapiens
uagcacaguucacccucgauuucccuucucuuuauuagaaauccagaguagacagugcua

SEQ ID NO: 2251549 - RNA, 59 nt, Homo sapiens
uguuauuauuuauauaauuaaguucagcacucgauguguuggcuaaaugaaugauagca

SEQ ID NO: 2251550 - RNA, 58 nt, Homo sapiens
uuaagagcauggugccagguugcucguaacugugcugauuaucugcuuaugcuuuuaa

SEQ ID NO: 2251551 - RNA, 58 nt, Homo sapiens
acccaaaaggcgaagguugcagugagcugagaucaugccacugcacuucagccugggu

SEQ ID NO: 2251552 - RNA, 61 nt, Homo sapiens
aaguuguguauaaauuagcauauauaaaaauguccuuauuugugcuaauuuaugggcucuu

SEQ ID NO: 2251553 - RNA, 61 nt, Homo sapiens
ugcugaguguuaccggacaccgugcuaggugaugugaucccauuaguaauacuugugagca

SEQ ID NO: 2251554 - RNA, 55 nt, Homo sapiens
aguggcagugugaggauccugcuuuagaagacuacagcguuuucaaugcuccacu

SEQ ID NO: 2251555 - RNA, 55 nt, Homo sapiens
aauuguacucccauaauucccuuguguuguggaagggaccaggugggagauaauu

SEQ ID NO: 2251556 - RNA, 91 nt, Homo sapiens
uuucucguuacagugacagaucugaguaguugcacagagacuggauagcccacgauguguaaauagcuacggaucugauccuuuacagaaa

SEQ ID NO: 2251557 - RNA, 66 nt, Homo sapiens
ggggccuaguggaagguaauuggcuaaugagagcuaaguuuucauuaauggguuagcuucagcccc

SEQ ID NO: 2251558 - RNA, 99 nt, Homo sapiens
gaggcaggagaauugcuugaauccaggaggcagaggcugcagugagccgagauugcgccauugaacuccuccugggcaacaagagcgaaacuccgucuc

SEQ ID NO: 2251559 - RNA, 69 nt, Homo sapiens
aucacagugagcauaugucuauaaaaguaaccaaccacaccugcugcuagaaauaacugccacuguggu

SEQ ID NO: 2251560 - RNA, 69 nt, Homo sapiens
uuuuuuucugguuguguaauuuuaaauagaaccccagggguuugcuuugagaaugcuaccagagaagag

SEQ ID NO: 2251561 - RNA, 81 nt, Homo sapiens
ccuggccccucugagcuacaccucuggaccugaauauccucaggguguauaggacuugguguaguuucuuauucagccagg

SEQ ID NO: 2251562 - RNA, 75 nt, Homo sapiens
cuuguauugcaauuggggaaacuggguaaguccuuucuccucucuggaccucaguuuccccaauuacacugcaag

SEQ ID NO: 2251563 - RNA, 71 nt, Homo sapiens
cugucucuucuugcuuuuugcuguugaaaguugcuuuuagcuucacaaugcagagggcaguggaagaacag

SEQ ID NO: 2251564 - RNA, 56 nt, Homo sapiens
uugagauggaguuucacucucgucacccaggcuggagugcaauggcaccaucucag

SEQ ID NO: 2251565 - RNA, 82 nt, Homo sapiens
guaugguggcaaugguagaauuauguauuggcuuuuaaagcuucuucucaaaagucacaugcauuuucuucaauucacauau

SEQ ID NO: 2251566 - RNA, 67 nt, Homo sapiens
guaauaauuugcuaccuggugggauauugugagguugagugaaucaucagugcuugcaaauuauuau

SEQ ID NO: 2251567 - RNA, 59 nt, Homo sapiens
uccagacucagauuaauuugcagcuuggcuuuugggcuuuaaacugucuuggguuugga

SEQ ID NO: 2251568 - RNA, 86 nt, Homo sapiens
ucagguaguucuuuauagcagugugaaaacagacuaauauagaaaauugguauugggaguggggcacugcuauaaagauaaccuga

SEQ ID NO: 2251569 - RNA, 61 nt, Homo sapiens
uugacuacaccaugccaggaacuuuuauaaguuaguuuucuugguuacuugguauaguuaa

SEQ ID NO: 2251570 - RNA, 88 nt, Homo sapiens
gguuuuguuugugacccguggugcaaaggauugagugaaagcuacugcucaguucaugguaggcaccauaguugguccagauaaggcc

SEQ ID NO: 2251571 - RNA, 90 nt, Homo sapiens
ugaagaacuaggugccuggaauguuccuaaagauucacuugggaaacagcuuaauauaguggacuuuggcaacagaccaacuaggcuuca

SEQ ID NO: 2251572 - RNA, 71 nt, Homo sapiens
uagggauguaauuucagaguuuuggaaaaacuuguaucccguaguccuugagccuuaaauuauaaacccua

SEQ ID NO: 2251573 - RNA, 104 nt, Homo sapiens
uugagccaggagucuuguucugucauccaggcuagagugcaguggugugaucucagcucacugcgaccucugccucccggguucaagcgauucuccugccucag

SEQ ID NO: 2251574 - RNA, 80 nt, Homo sapiens
gaucccuugaaguagguaccguucaauuccccuauuuacagacaaggaaauggauugcaugguaccuacuucagaggguu

SEQ ID NO: 2251575 - RNA, 62 nt, Homo sapiens
ucuuucacuuggguacuuaaauuuagcauggaucugaagacucgugcaguacuuaguaagga

SEQ ID NO: 2251576 - RNA, 62 nt, Homo sapiens
ucaguuugccaguauuuuauugaggauuuucacauugauguucaucagggauauuggccuga

SEQ ID NO: 2251577 - RNA, 60 nt, Homo sapiens
uagggcuuuccggccugucagaaagugacauucuuuauuuaccacaggucagaaacccug

SEQ ID NO: 2251578 - RNA, 56 nt, Homo sapiens
ggcucaggguacuucuccuuugcuuugauucucaggagcagcugauacccucagcc

SEQ ID NO: 2251579 - RNA, 99 nt, Homo sapiens
gaggcaggaggaucguuugaacuugggaggcggagguugcagugagccaagaucacaccauugcacuccagccuggccaacagagcgauacugcgucuc

SEQ ID NO: 2251580 - RNA, 61 nt, Homo sapiens
cuauuagguuggugcaaaaguaauggcaaaagccgcuauuacuuuugcaccaaccuaauag

SEQ ID NO: 2251581 - RNA, 129 nt, Homo sapiens
gcugcuaagaugagucucuagaucacuugucaucauuauguuguguggcugauaaagacuuuaucuuuaaugcaucccaaaauguaguugcugacuucccuguauuucuuuauucacucauuuuuucau

SEQ ID NO: 2251582 - RNA, 75 nt, Homo sapiens
gugguuuuagucccuuucuauuaaugagaaguaaaaaugugugucucauuuaaacagaagggauucaaaaacuac

SEQ ID NO: 2251583 - RNA, 74 nt, Homo sapiens
ccggagccaaagcugccuugcugaggagaaauccaaguggguuuccuccucccccaaggcauccagccucccgg

SEQ ID NO: 2251584 - RNA, 63 nt, Homo sapiens
cuaugguuucucaaacuccugacacccucacaggcugcacauaucccaguuugagaaacguag

SEQ ID NO: 2251585 - RNA, 81 nt, Homo sapiens
uaugaggcauuccagaaauuuuagcagucagggaccaucuuaauccaaguucaaggacuaaggauuuuuggaaccuucaua

SEQ ID NO: 2251586 - RNA, 67 nt, Homo sapiens
gagucaucugauucaauucccucauuuuccagaggaggaaacugaggcuagucagaucagaugacuu

SEQ ID NO: 2251587 - RNA, 57 nt, Homo sapiens
uuaggccuuugauuggggugcucugugcuacagguagugccaaaucgagggcucuga

SEQ ID NO: 2251588 - RNA, 60 nt, Homo sapiens
gugugcacaacaugcagguuuguuacguauguauccaugugacauguuggugugcugcac

SEQ ID NO: 2251589 - RNA, 75 nt, Homo sapiens
gucccaugggauuugaagacauuagguaggucccugcuauaagggccuugcaguacauucagcauccucugggac

SEQ ID NO: 2251590 - RNA, 64 nt, Homo sapiens
guagagcuagggacucgcaauguuucuuuggcuggucuugaacuugugagcucaagcaaucuac

SEQ ID NO: 2251591 - RNA, 82 nt, Homo sapiens
gcugagaagacugcauagucauuucuaucagaugcugccaaauagcaaauacaaugaguggagacuguguguagaguucagc

SEQ ID NO: 2251592 - RNA, 87 nt, Homo sapiens
accuuuuuagaguuacauauaagugaaaccagaaaguauggagucuuuuuugucuggcuuucuuuacuuaauguagugcuuugaggu

SEQ ID NO: 2251593 - RNA, 88 nt, Homo sapiens
aagcucccuaggugguuuugaugagcagguaggcuuaagaacuguuaccuuaucucaagaccauuuuuuuuccugaacagcggagcuu

SEQ ID NO: 2251594 - RNA, 58 nt, Homo sapiens
uuuuccauuuacuugugcugucucuguacacagcuaggcauuguacaguaauggaaaa

SEQ ID NO: 2251595 - RNA, 57 nt, Homo sapiens
agucuugggaauaauuuugaaaggcuccauguaaaauguagguuauuucccaagacu

SEQ ID NO: 2251596 - RNA, 68 nt, Homo sapiens
aguccaugcuuaugugcauguccacuaguccauauuaugucauugauauugugucaauaagcaggauu

SEQ ID NO: 2251597 - RNA, 58 nt, Homo sapiens
cuccauccagaaucaauagcaguuaucauucauuuugauguguuuguuucuggaggag

SEQ ID NO: 2251598 - RNA, 57 nt, Homo sapiens
caccuugucccggcuccauuaccucuacagcgagaaaaugguguugccaacaaggug

SEQ ID NO: 2251599 - RNA, 127 nt, Homo sapiens
uucagccaguuucaggaggacugguaucauuagugcaaaagugauugcgguuuuugccauuacuuucaauggcaaaauccacaauuacuuuugcaccuaauaguucuuccuuguacaucugguagaa

SEQ ID NO: 2251600 - RNA, 61 nt, Homo sapiens
guauauguucuugcacuggaaagaacugcagaauaauuuuuccuuuggaagaugcauauac

SEQ ID NO: 2251601 - RNA, 89 nt, Homo sapiens
ccucuucugaacuccugcagcugauaaauacagucuaguccuccauggucucaacagcuaguguuugccagcguagccuucuagagagg

SEQ ID NO: 2251602 - RNA, 80 nt, Homo sapiens
gguuuuuuguccuugcgauaguuugcugguaaauuuuagucuuuaaaguuugguauucucauugcacgauggagaagacc

SEQ ID NO: 2251603 - RNA, 71 nt, Homo sapiens
uucaccagucagcuuguccagagacucugagcagaguagccagcagggucugcaggcaggcuugcugugaa

SEQ ID NO: 2251604 - RNA, 82 nt, Homo sapiens
uugcucagccuugagagggaguacagaaccgaagggaaaguuuauuguucuuuugguaguaaucccucacaaaauaaagcaa

SEQ ID NO: 2251605 - RNA, 78 nt, Homo sapiens
cauacagcugauugucaaagugauuguaauuagguccuccaauuucaucugcaguacuucgcuuuuauuuguuguaug

SEQ ID NO: 2251606 - RNA, 76 nt, Homo sapiens
cucaccuggagagcuugcuaauacacugguccccauccuaaucccccaagguaaaggcaaacucuccaaggauggg

SEQ ID NO: 2251607 - RNA, 126 nt, Homo sapiens
aaagugagccaugcaaaaaauauggaugacuguuauaugcauauugcuaagugaaagaaaccaauccaaaaaggcuauaugcuauaggauuucauuuguaugacauuuugcaaaaggcaaaacuuu

SEQ ID NO: 2251608 - RNA, 63 nt, Homo sapiens
uuggccuggggaagccaguggggauccgugcccugggcagaccucauugcuaucccaggcuga

SEQ ID NO: 2251609 - RNA, 93 nt, Homo sapiens
guuuucauguuccaguacagaaugguuuuaucagcguccaaaaaauauucuuuuaauuuguuuggaagugcuuuaaaauuauaacaugaagau

SEQ ID NO: 2251610 - RNA, 130 nt, Homo sapiens
ucugggcgugugcaguaguguagucucugcaugauuucuuugacuguagauggcaugaaugauaucugugauuucuuugguuguuuagggugcauuuauuaguagaggcugugaugaaguuuugcugagg

SEQ ID NO: 2251611 - RNA, 67 nt, Homo sapiens
uuuauggaaggacugaaucucaaccaugcugacugcagcagaaaguggaaauuaagucuuuccugag

SEQ ID NO: 2251612 - RNA, 64 nt, Homo sapiens
uguucauuaguugaagugcagggagaacacuuuguacaucuuccuaaucucagcuaauucugca

SEQ ID NO: 2251613 - RNA, 64 nt, Homo sapiens
ggaaauuuugacucauucccuuaaguacuagcuguuaagugguauuuaauauaugagaguuucc

SEQ ID NO: 2251614 - RNA, 64 nt, Homo sapiens
ugccuuuuggucacugccgccgccagcagcccaggcugacugguuugacaguggccauugugca

SEQ ID NO: 2251615 - RNA, 82 nt, Homo sapiens
gugccagccauggcugauuugagagaggguguuuauaucccagugguguagaaagcucuucugaaauccagaggccgggcac

SEQ ID NO: 2251616 - RNA, 59 nt, Homo sapiens
ggugagguaucauugcccaggcuggucuugaacuccugggcucaagugauccucuugcc

SEQ ID NO: 2251617 - RNA, 55 nt, Homo sapiens
cugagaauguaaaugaagcuuuccggcuccugggaaguuauagacuuguucuugg

SEQ ID NO: 2251618 - RNA, 86 nt, Homo sapiens
gagaauugcuugaacccgggaggcggagguugcagugagccgagaucgugccauugcacuccagccuaggcgacagagcgagacuc

SEQ ID NO: 2251619 - RNA, 69 nt, Homo sapiens
cauaacuaagggccaugauggaggauaaauauccauguugcuuguucccuucuggcuuuuaugucugug

SEQ ID NO: 2251620 - RNA, 81 nt, Homo sapiens
agauaaugauacaugcccaaagaguucagguagauuucaaugugguuggaagcuccugguaucuuuguuguacaauuauuu

SEQ ID NO: 2251621 - RNA, 85 nt, Homo sapiens
cguguuagacacggugggcucguucguguuagacacgguggacucguucguguuagacacggugggcucguucguguuagacacg

SEQ ID NO: 2251622 - RNA, 56 nt, Homo sapiens
uuugagauaggaacucacuaugcugcccaggcaggucuugaacuccuggucucaag

SEQ ID NO: 2251623 - RNA, 76 nt, Homo sapiens
gccagcugggaucaagcuacacccuuuggaaagaaucacuaucugcucuaaucauguagacuuauugcagccuggc

SEQ ID NO: 2251624 - RNA, 86 nt, Homo sapiens
ucagguauuuauuuauagcaaugcaagaauggcuuaauacagaaaauugguacugaggaguggggcauuacuauuaagauaccuga

SEQ ID NO: 2251625 - RNA, 64 nt, Homo sapiens
auugugaguagugccacaauaagcauacguguacauguaucuuuauagcagcaugauuuauaau

SEQ ID NO: 2251626 - RNA, 63 nt, Homo sapiens
uggcagucaaugauauacaaaaguggugguaacaauguuccaaugugauaucaaugauagcca

SEQ ID NO: 2251627 - RNA, 115 nt, Homo sapiens
guggcuggucuguaguggugaggggcuuuggauggugggacugaauccuaggaucuaaggugggugcucagugcuguaccaucuaaggaugcuguucugugcucagauaagccac

SEQ ID NO: 2251628 - RNA, 59 nt, Homo sapiens
ccaucugagagaacaaucagaugauuuuauuacguuauuuggaaugugcacucagauug

SEQ ID NO: 2251629 - RNA, 61 nt, Homo sapiens
guaaaaaaagugaugaugucuagggccuuugaguguuguguuugucaucaucuuuucuugc

SEQ ID NO: 2251630 - RNA, 56 nt, Homo sapiens
cucucuuggagaguccaucaucacugucccaguugagccaugggacuccaagggag

SEQ ID NO: 2251631 - RNA, 56 nt, Homo sapiens
cccagggggcagagguugcagugagcugagaucgcgccauugcacuccacccuggg

SEQ ID NO: 2251632 - RNA, 60 nt, Homo sapiens
ucuuuucaaguauucaagugauagagaaugugucugucugugaaugaacacuugaaaaga

SEQ ID NO: 2251633 - RNA, 78 nt, Homo sapiens
ccuuuggauacugucucuugcuccugcccuccaggccuaacgccgguauagugcagcagggggaagacaguguggggg

SEQ ID NO: 2251634 - RNA, 103 nt, Homo sapiens
guuguaacuccacuucugccucuuuggucaauugcuguggggaauuuaaggaagaaucuccuugcaggguuugauaaagauguguaaguugauaaguugcaau

SEQ ID NO: 2251635 - RNA, 69 nt, Homo sapiens
aagcaggacucucacucucccacuuagguccucccauuggacaaggugcugagcagagaauccuggcuu

SEQ ID NO: 2251636 - RNA, 89 nt, Homo sapiens
cuaagucacacuguuauuugaccugaagccugguacuuagaauuguucccguagaaguggcucaguugcaaaucaguucagugacuuag

SEQ ID NO: 2251637 - RNA, 90 nt, Homo sapiens
gacuguagcuuuguaauguguuuugaaaucaggaagucugaggccccuagcuuuguccuucuuucucaagauuguuuuggcuacuuaguc

SEQ ID NO: 2251638 - RNA, 72 nt, Homo sapiens
gucaucagccauccuacacuucuaugucauguugacaaaggcagccugacuagucauaggcaugggggugac

SEQ ID NO: 2251639 - RNA, 62 nt, Homo sapiens
ggugccuacugugugucaggcauauuaucuucuaucccacaauaaccugaaaguauggcacc

SEQ ID NO: 2251640 - RNA, 84 nt, Homo sapiens
ucucuuucuacccccauucaccauggaccaggggccuccauuuccugggggcucuugcggcaugugauuugggggucccuggga

SEQ ID NO: 2251641 - RNA, 127 nt, Homo sapiens
gcagacuggggaccgaagcuucugcucccauacacuagggcuccugcagaacauggugacuccaggauucuacaaucuggaccuaggguaaaacugggaagcaaauuuuggcugccauacugucugu

SEQ ID NO: 2251642 - RNA, 118 nt, Homo sapiens
uggcuguuaucugaucaagugucaagguaucguauagcuuguguucaagucacccuuauuuuacuuaauaauggccccaaagcgcaagagguaugaugcuggcaauucggauaugcca

SEQ ID NO: 2251643 - RNA, 74 nt, Homo sapiens
uuacucugacuugggguaggaauauggaaugagauacuguagucuacauauuccacuaccguagcccagggugg

SEQ ID NO: 2251644 - RNA, 88 nt, Homo sapiens
aggcacuugcuggcuggcugagugguaaguagaggagugaauggcuccucacacccguccccgccagcccagcccucaguaucugccu

SEQ ID NO: 2251645 - RNA, 87 nt, Homo sapiens
gagguauagaagccuguucccaaggcaggagcaacuuucugauccuagaaagcuaaugacuuugggugaaaacagucacauguccuc

SEQ ID NO: 2251646 - RNA, 63 nt, Homo sapiens
ugaaauacuuuggcucuuuguuauuaauaaccugaacaaugaaagagcccaaaguaguauuca

SEQ ID NO: 2251647 - RNA, 89 nt, Homo sapiens
agaggggggacuuuggaaauguaaacaauggggcuaccuuauagcuuuugauggcccuaggcauuuuacuuucaugggccccucccucu

SEQ ID NO: 2251648 - RNA, 64 nt, Homo sapiens
gacuuugguagaggaaaaaucucauucuuacauauuacuuagauuuuacuuccucauuagaguc

SEQ ID NO: 2251649 - RNA, 76 nt, Homo sapiens
ugcugagucauguaauaaugcugcuaaugaugcugacaaugagcagaaacacagagcccuuauuacaugaugagca

SEQ ID NO: 2251650 - RNA, 78 nt, Homo sapiens
gguaauugaggcacucuguacaaaucugcagguaaaugucaagcacacugacagggcauggugcagaguucugaggcc

SEQ ID NO: 2251651 - RNA, 66 nt, Homo sapiens
uauuucuaguucuagauccuugaggaaucaccacacugucuuccacaaugguugaacuaguuuaua

SEQ ID NO: 2251652 - RNA, 89 nt, Homo sapiens
uguggguuaauugauacacauuuuuauauauuuaaggggagcauaugcuauuuucuuaaaugcauagaauguguagugaucaaguuaca

SEQ ID NO: 2251653 - RNA, 113 nt, Homo sapiens
acuaaaauugguuucuaguuaaaaccaaucugaauucacauuaaacuuucccuuugaagcaaguuggaaguauaaacuuaguggaguacagugggacugguagccauuuuagu

SEQ ID NO: 2251654 - RNA, 58 nt, Homo sapiens
ggaucuggucuuauuuuuacaggaaauaaacauggucuaugagaauguuaccaggucc

SEQ ID NO: 2251655 - RNA, 92 nt, Homo sapiens
gcuuuuugagcuugauuuccugguggaccguccuagggucaccuggccagaagguaguacccagugguuacauaaggaguaagucggaaggu

SEQ ID NO: 2251656 - RNA, 64 nt, Homo sapiens
uuggagcccuaacucucaguacuucagaaugugacuguacaguaucugcagaaagggccuucaa

SEQ ID NO: 2251657 - RNA, 104 nt, Homo sapiens
gucucuccuauuucuguguauguuauaaauagagacacuggcugcauuuauucuuaauuguuuuuucaacguauuuauauagcagagccauggaagcuagagac

SEQ ID NO: 2251658 - RNA, 56 nt, Homo sapiens
uugagauuggagucucgcucugucguccaagcuggaguguauuggcacgaucucag

SEQ ID NO: 2251659 - RNA, 71 nt, Homo sapiens
agucagauuuccuccuacgcuuaucacuuuauauguggaaaauggaguaaaagaguaggaggaauaaggcu

SEQ ID NO: 2251660 - RNA, 68 nt, Homo sapiens
uuguuucuggcagcagaugaaaacaaaugccccaaaaugugcuuguccccaucugcugccagaaguga

SEQ ID NO: 2251661 - RNA, 130 nt, Homo sapiens
caaaccugaaaauccaaaaugcuccaaaaucuaaaacuuucugagugcagcaugaugacucaaagaaaaugcccacuggaguuugcuagaaacguuuugcagcauuuugaaucugugauuuuuggauuug

SEQ ID NO: 2251662 - RNA, 59 nt, Homo sapiens
uaguaaagaggucuggagccagauuggguucaaauucuggcuccacacuuuauuaacug

SEQ ID NO: 2251663 - RNA, 62 nt, Homo sapiens
cagugcccagcacauagcaguugcucaguaauauuuuuauugaauaauucuuauugccacug

SEQ ID NO: 2251664 - RNA, 91 nt, Homo sapiens
auucugacgguaugucaaggaauucucaauagaguuaauuuuuuuaaaaaacugacucuugaaaguugacuuggaauuuaccaggcagagu

SEQ ID NO: 2251665 - RNA, 66 nt, Homo sapiens
ggcaaaggcagcaugaaggcuuguucagaucaaaagcuaaaagguguucuucauugcuguuuugcu

SEQ ID NO: 2251666 - RNA, 115 nt, Homo sapiens
ucuauuuuuuuaagguacuggugcccauauaguaguacuguuagguuuucuuuccauuuaugaauuuggcauuaguacucuguaaugcacccauguuggaccauaaaacagugga

SEQ ID NO: 2251667 - RNA, 129 nt, Homo sapiens
cuucccaaagugcugggauuacaggugugagccacugcacugggccaucacuuaauauuuuuauuaaaaaauauaugaauucuggccaagugcaguggcucacaccuguaaucccagcacuuuaggagg

SEQ ID NO: 2251668 - RNA, 61 nt, Homo sapiens
aaugggaaugugcacuauguauuaaguguguacaugcaugcauggagcauacauuucuguu

SEQ ID NO: 2251669 - RNA, 59 nt, Homo sapiens
ugcuugguaaaucuucacuaagacugaguaguaaauuugcucugaagaauuagagagca

SEQ ID NO: 2251670 - RNA, 62 nt, Homo sapiens
ugggggaaguuaguaaauuguaagcauuugugcuggcaagcuuuaauugacucuuuucccca

SEQ ID NO: 2251671 - RNA, 123 nt, Homo sapiens
ggcugaggcaggagaaucgcuugaacccuggaggcggagguugcagucagccgagaucguaccacugcacuccagggggcaacagugcaagacuccucaaaaaaaaaaaaaaaaaaauuagcc

SEQ ID NO: 2251672 - RNA, 70 nt, Homo sapiens
agugacuaugacugcaagaucacugugugcagaaaucucuagaaaugugugucuuguagcucaaguuauu

SEQ ID NO: 2251673 - RNA, 55 nt, Homo sapiens
agauagcccagcauuuguucccuggcugcuaacucacccacaaagcuggcuaucu

SEQ ID NO: 2251674 - RNA, 83 nt, Homo sapiens
ggcuccucuuggcauccucugucugcucaaccacccacaacgggccacguggaauggagagagggugcacgguguggggagcc

SEQ ID NO: 2251675 - RNA, 93 nt, Homo sapiens
ucaaauuccacaagaucuuuaauuagcuguauggacuaugcuuaaaauacaauugagaauacuaugagauaauaaagacuuguuugguguuga

SEQ ID NO: 2251676 - RNA, 78 nt, Homo sapiens
guaucuuuauggcagcaccccacucuacugguaccaauuuacuauauuaguuuguucucacacugcugauaaagaugc

SEQ ID NO: 2251677 - RNA, 74 nt, Homo sapiens
cagagauaagcagccacuuguccagggacauguggggccaccuggcaucccugucgucaagucucugcccucug

SEQ ID NO: 2251678 - RNA, 56 nt, Homo sapiens
ugaguuagguugucaaugucuuaaggaaugugauccuugaauuccaaccugauuca

SEQ ID NO: 2251679 - RNA, 62 nt, Homo sapiens
gcacgugggugugugcacguggguguguguacgugcucauccuugguuggcgcccuaugugu

SEQ ID NO: 2251680 - RNA, 71 nt, Homo sapiens
ggauuuguuuugccaguauuuuauugaggauuuucacaucaacguucaucagggauacuggccuuaaauuu

SEQ ID NO: 2251681 - RNA, 130 nt, Homo sapiens
cugcagaccuucgcggugaguguuacagcucuuaaggcagugcaucuggaguuguuuguuccucccggugggcucguggugucacuggcuucaggagugaagcugcagaucuucauggugaguguuacag

SEQ ID NO: 2251682 - RNA, 81 nt, Homo sapiens
cucagcaaaccaacgaguuucuauuaauaucucauggcuagaguucugagauaauagcuauaggaucuuugguuguaugag

SEQ ID NO: 2251683 - RNA, 80 nt, Homo sapiens
uauuagcuugagcaacaaauuaauguguauuuaccucuucgaguaguaaaaugcugucaaauuguguucuuaagcagaug

SEQ ID NO: 2251684 - RNA, 58 nt, Homo sapiens
ugagaugaguucucgcucugucgcccaggcuggagugcaguggugagaucucggcuca

SEQ ID NO: 2251685 - RNA, 84 nt, Homo sapiens
uucgauuuuacaggcucacagucagaagggacuugccuugucuuggauaagacuuuggacugugaacuuuugauuuaaugcgga

SEQ ID NO: 2251686 - RNA, 57 nt, Homo sapiens
uguucauggauccaguggcuucauguauaucugguagcuacaacuuuuccaugagca

SEQ ID NO: 2251687 - RNA, 113 nt, Homo sapiens
auguaaauccuugcauauggcuuaacacacgugggcaaugugcacauuuacacauaguccagccuauacaugugcacaugcuuacaugugauuugauauguauggguguauau

SEQ ID NO: 2251688 - RNA, 68 nt, Homo sapiens
uugcuugaagcugcgaggcggaggcugcagugagacgagauugcgccauugcacuccagccuggguaa

SEQ ID NO: 2251689 - RNA, 120 nt, Homo sapiens
guccugagcagcggcugaaugggcucuaccugugacucaccguuccucuccugguaggcagcaacaauaugggugaggucguagucauaggcaaaggggcuggucccguugaucacggau

SEQ ID NO: 2251690 - RNA, 55 nt, Homo sapiens
ggagaguaguggaaaacaugcuuccaaagaaaguaagaaauuucuacugcacuuc

SEQ ID NO: 2251691 - RNA, 60 nt, Homo sapiens
caggaagagauacuuuuuuucucacuuuauuuucuucugaauaaacagugucucuuucug

SEQ ID NO: 2251692 - RNA, 56 nt, Homo sapiens
uggcuugaauuguguuuugauaagcguguauugcuuuaguaaagccagucaaguca

SEQ ID NO: 2251693 - RNA, 74 nt, Homo sapiens
guagguguugauuagauccaguugauugaugaugcuguucaguucaacgguauccucacugaaauuucaccugc

SEQ ID NO: 2251694 - RNA, 61 nt, Homo sapiens
gugaacagcagaugagugagugaagauucauuuguauuuagagccacucacuguugcucac

SEQ ID NO: 2251695 - RNA, 76 nt, Homo sapiens
ugcaauuccugaguguagaaacuucuugcacuuauuuaaaauuuaggagagaacauuuaagccacucagguaugca

SEQ ID NO: 2251696 - RNA, 65 nt, Homo sapiens
ggggggcauuggcacagguguagaaaaugaagccugaggguccccugacuuguccgagguccccc

SEQ ID NO: 2251697 - RNA, 62 nt, Homo sapiens
gugguugcuuugugccaccauuauuccugacucugaauuuugaugcuaccuaaagcaaccau

SEQ ID NO: 2251698 - RNA, 67 nt, Homo sapiens
aguaccuggguaucacugcuggcuauucaggacccaagggcucuguaguuagcagaugaugaaugcu

SEQ ID NO: 2251699 - RNA, 64 nt, Homo sapiens
uguaaaugcucuuuaugaaguuggaggaaauuacccucuauuccaaguuuucuaagaguuuaua

SEQ ID NO: 2251700 - RNA, 129 nt, Homo sapiens
acagagaacagugagcggagagaaaaagucuccuuaacccagaguuccuugucuuucaccaguggggacuuccaugacuuggcuagacugaggggucuggggugugacuuggcuguuucugcucucugu

SEQ ID NO: 2251701 - RNA, 87 nt, Homo sapiens
cauuuaaaaaaucuuagcauuacaggcugaagaaaaucuugguauggugauuaucuuuagugacaguugugcaagaaaaauuaaaug

SEQ ID NO: 2251702 - RNA, 58 nt, Homo sapiens
gagacagcgugguuaacauuuugucgugaaucauuuagaauguuuuuccauguuucuu

SEQ ID NO: 2251703 - RNA, 64 nt, Homo sapiens
uucaguuugccaguauuuuguugaagauuuuuccaugaauguucaccaagaauauuggccugaa

SEQ ID NO: 2251704 - RNA, 56 nt, Homo sapiens
cccuugcuggcuucagguuugagcaagcacaguucaagugaugguggccacaaggg

SEQ ID NO: 2251705 - RNA, 60 nt, Homo sapiens
gucagaugaguagguagcaaaaauuuucucccauuuuguagguugccuauucacucugau

SEQ ID NO: 2251706 - RNA, 56 nt, Homo sapiens
caagagggugugaacuccccuacguuugcagccccgucaagcaccacacucucuug

SEQ ID NO: 2251707 - RNA, 62 nt, Homo sapiens
uucugccacuuggaccauaggacccagcagauucaauggugcuugaggugugaggggcagag

SEQ ID NO: 2251708 - RNA, 73 nt, Homo sapiens
guuugauauguaacuacuccuuauaugccauuuuauuuugugcauacaugugauuguaguauacauauuaggu

SEQ ID NO: 2251709 - RNA, 76 nt, Homo sapiens
uuuaagagcacagugaacaauauccucuguucugcaucggcaaucacgauagaggguugucaccugaguccuugag

SEQ ID NO: 2251710 - RNA, 58 nt, Homo sapiens
ugccuguccuuugguuguccacaaggaauuuccuuaugggcaaauugugagggaggua

SEQ ID NO: 2251711 - RNA, 58 nt, Homo sapiens
ggcuccuacaaaguuauuuuaguuuacaguuuauaaccugauguuucuguggggagcc

SEQ ID NO: 2251712 - RNA, 76 nt, Homo sapiens
caggacaguggggguggguuucuguugcuuuaagcccccgaguuugcuacagcagcccaguccccgaaccuuccug

SEQ ID NO: 2251713 - RNA, 78 nt, Homo sapiens
gaagcaaguggccuugagguugacggaauauucugaaacauuacgagaacugaucaauguuaaggcuuauaaugccuc

SEQ ID NO: 2251714 - RNA, 73 nt, Homo sapiens
aguguacauucacaugagcagaagagauacacuguauuuccuauacacuauaucucugcugcuuauugucacu

SEQ ID NO: 2251715 - RNA, 57 nt, Homo sapiens
auuuuacccuucuucagcuucugucaauugaauguguaggacuacagaggguaggau

SEQ ID NO: 2251716 - RNA, 73 nt, Homo sapiens
gagguucuacuggcauuuaguggguagaggacaaggauggcacuaaauauccuacaaugcacaggagagccuc

SEQ ID NO: 2251717 - RNA, 82 nt, Homo sapiens
uccgcugcuucuugaggggaggugggcuuggugccuugcuccaagccucaguuucccucuguuaaaugggaaaaguaaugga

SEQ ID NO: 2251718 - RNA, 75 nt, Homo sapiens
cuaaaaaugcuguaaaguucucauuguagccuagcagucuugggcuuaaugggucacuuuaacuguagacuuuag

SEQ ID NO: 2251719 - RNA, 56 nt, Homo sapiens
ucacacuguuuugauuauuauaacucuguauuaaguuuugaaaucaggaaguguga

SEQ ID NO: 2251720 - RNA, 78 nt, Homo sapiens
gggaauccuuuuagggugugguaggauugguuacucaauaaauugaaaaauaaagcuaucauaucaucuggugauccc

SEQ ID NO: 2251721 - RNA, 61 nt, Homo sapiens
cugaauccuugcacuaacuuaaggaggucugcacaggcuucccugagggcaaggaggacgg

SEQ ID NO: 2251722 - RNA, 92 nt, Homo sapiens
cuggagacuucuagguugcagcauucugguuccugguccaguuuccugauggacuugaaaccuaggucugagaaaugcugcagcugauccag

SEQ ID NO: 2251723 - RNA, 64 nt, Homo sapiens
cuauguguccauguguucucaucauuuaacucccacuuauaaagugagaacaugugguauuugg

SEQ ID NO: 2251724 - RNA, 105 nt, Homo sapiens
auacuggaucuggauaaccugcaauaacccagugucugugauggguuagucuccccuuaaauuaucacagauacuggguuauugcaggucuggauuacauagugu

SEQ ID NO: 2251725 - RNA, 86 nt, Homo sapiens
cuugccaagugcauggagcaacagaccuaucacaguuacagccccacggcacuggaagugucugugcccagcucugcugacccaag

SEQ ID NO: 2251726 - RNA, 63 nt, Homo sapiens
cuauguguccauguguucucauaauuuagcucccacuuauaagugagaacaugugguauuugg

SEQ ID NO: 2251727 - RNA, 78 nt, Homo sapiens
uacucuugucacuguuuccuauuauauuugggugauucaguauaacagaagaauguaauaggaaacguguggagggug

SEQ ID NO: 2251728 - RNA, 57 nt, Homo sapiens
ucuucuagcggaacccucuuguagcuacugagauauacacagaaguuuccuggaagg

SEQ ID NO: 2251729 - RNA, 58 nt, Homo sapiens
ccuuugugcuccucucaguaugugcauuaacugcauuugacagugagucacagcaagg

SEQ ID NO: 2251730 - RNA, 81 nt, Homo sapiens
ugguauggcuucuuuaaauugagguucagagaauuugacagcuuguucaaaguuaaauauccaguuaagagacaguuacca

SEQ ID NO: 2251731 - RNA, 61 nt, Homo sapiens
agacacacaccccuaaucucaaugcugaggucacugcuaugaguuaggagaguguggcucu

SEQ ID NO: 2251732 - RNA, 57 nt, Homo sapiens
auuguuaugguugugguuuugguuguuacaauuacuagcuccacagcuauauauaau

SEQ ID NO: 2251733 - RNA, 88 nt, Homo sapiens
uuuacugcuuguaaaaugggacugacgccucccagaucuggagaggacuuuucggagugugucuaguccuguacaccugcccugugaa

SEQ ID NO: 2251734 - RNA, 78 nt, Homo sapiens
agggguccauuuuuauauguuacucccucuagcaagguugaauaaauaugccagugaaacauggaagaauggauuuuu

SEQ ID NO: 2251735 - RNA, 97 nt, Homo sapiens
ggcuugacaacuugugaaggggauucaaggacuggauugcgggauagcacgaauguccucaauaagguuacuuggguccuauaaaguugggggaguc

SEQ ID NO: 2251736 - RNA, 77 nt, Homo sapiens
acuacaguaauguuaaucuuuguggagcuauugcacuuaacuugcuugcaucauucagauucagcauuacuuugagu

SEQ ID NO: 2251737 - RNA, 84 nt, Homo sapiens
gagaaaaaauaucgaugagucacagaagguuuugaugaaagcacagauuuuauuccacuuagugacucauuugugacuuuucuu

SEQ ID NO: 2251738 - RNA, 72 nt, Homo sapiens
ccauuuucccuagucuuuaucaaagucagucuucauucuugcauucacuuuguauagcgacuggcugagugg

SEQ ID NO: 2251739 - RNA, 74 nt, Homo sapiens
uccaucccuuuauuuugagccuaugugugucuuugaacaugagaugggucuccugaauacagcacacugauggg

SEQ ID NO: 2251740 - RNA, 58 nt, Homo sapiens
caacucuagaaugcaccguucacaaagacuaaaaugugaacagcaccuccuagaguug

SEQ ID NO: 2251741 - RNA, 70 nt, Homo sapiens
uuguucugagacagggucucacacuguugcccaggcuggaaugcaguagugugaucuuggcucacugcaa

SEQ ID NO: 2251742 - RNA, 74 nt, Homo sapiens
ggguuuucaaaauaauugcaguucuguguuauaucccauuugggggaggugacaggaugcagauaaacaaaccc

SEQ ID NO: 2251743 - RNA, 77 nt, Homo sapiens
auuuuuuaaacauuguacauucuguagcugugucugcuucaaaauuauagcugcacgugguaaauguaaaggaaaau

SEQ ID NO: 2251744 - RNA, 61 nt, Homo sapiens
ucaagaugacauuuagguggggacacagccaaaccguaucacucccugagucuuagcuuga

SEQ ID NO: 2251745 - RNA, 86 nt, Homo sapiens
gcugggggugcaaagauaaaaauguucauccauucgauugcuaacaauauuuauugaguaacaauuuuguucaaugcacucuaagu

SEQ ID NO: 2251746 - RNA, 60 nt, Homo sapiens
guggcagagcagcuugcacaacagcuuggagcuguuguggagucuucuguucuggaccac

SEQ ID NO: 2251747 - RNA, 66 nt, Homo sapiens
guauuucuaguucuagaucccugaggaaucaccacacugacuuccacagugguugaacuaguuuac

SEQ ID NO: 2251748 - RNA, 83 nt, Homo sapiens
gagcauagugacagauguuagcagcucuggugacaaggugacacagugacccugucacccuuuguuaagaaucaucauagcuc

SEQ ID NO: 2251749 - RNA, 69 nt, Homo sapiens
ugugucagugauugcuuucauggaaacuuuucuccagucaauuccaggaagaguuacauacaagacaca

SEQ ID NO: 2251750 - RNA, 64 nt, Homo sapiens
uuacagcugggugugucugguacauagucaucugcgacuaagugaucauuucauguagcuguag

SEQ ID NO: 2251751 - RNA, 55 nt, Homo sapiens
cauuguggucaaggauggaccacauauaugaugguggucccauaagauuacaaug

SEQ ID NO: 2251752 - RNA, 64 nt, Homo sapiens
auugugaauagugcugcaauaaacauaugugugcaugugucuuuauagcagcaugauuuguaau

SEQ ID NO: 2251753 - RNA, 104 nt, Homo sapiens
uuuuaauuugagggaucauagucauugucccucaaugacuaugaucccuuuuaauuggggucauagacauugagggacaaugacuaugaucccucaaauuaaaa

SEQ ID NO: 2251754 - RNA, 57 nt, Homo sapiens
aaaggcauguugauagguagauguaucuauguauauaaauaugauuaacgugucuuu

SEQ ID NO: 2251755 - RNA, 82 nt, Homo sapiens
guuuugaacuaagggaauguaaguuuuaugagaguagagaccaaaucuacuuuugcucaacuuuauauuucaggugcagggc

SEQ ID NO: 2251756 - RNA, 61 nt, Homo sapiens
ccauuaauguaauuaguaaaguugcuggucaacaguaagcuauuaguaguuacauuuuugg

SEQ ID NO: 2251757 - RNA, 71 nt, Homo sapiens
cuugagcccaggagauggagguugcagugagccaagaucacaccacugcacuccagccugcuggauuuagg

SEQ ID NO: 2251758 - RNA, 66 nt, Homo sapiens
ugaaagaaguucuacucugaguaaaaugcuauuaaauagcaugacauauuguagagaaaucuuuca

SEQ ID NO: 2251759 - RNA, 65 nt, Homo sapiens
caguguucuguugguguuuaaucacugcagggacgccugccugauucuucacccacacuccauug

SEQ ID NO: 2251760 - RNA, 88 nt, Homo sapiens
gggcaugagauuugggaggggccaggggcagaauuauaugguuaggcuuuguguccccacccaaaucucauuuugaauuauaaucccc

SEQ ID NO: 2251761 - RNA, 81 nt, Homo sapiens
auuuuauuuccugaagauaggacaugaugggugcugugagaugguauuuaaaguaccugucugcaaggaaaacuuuaaaau

SEQ ID NO: 2251762 - RNA, 62 nt, Homo sapiens
gucuuggcaugugcagcugggauggaaaugcuccuccaguggacaguuacagcagcuaagac

SEQ ID NO: 2251763 - RNA, 71 nt, Homo sapiens
ccuucucuccuggugauuggagugugaauuucuugagguuuauuuuaucagcauccaggaauugaagaagg

SEQ ID NO: 2251764 - RNA, 86 nt, Homo sapiens
ggagaaucgcuugaacccaggguggagguugcagugagccaagaucgcaccauugcacuccggccugggugacagggugagauucc

SEQ ID NO: 2251765 - RNA, 74 nt, Homo sapiens
gccccuuguguaacaacagcacuccacugccccaucccugagcagagcgcuguguguugcagcagagugggggc

SEQ ID NO: 2251766 - RNA, 58 nt, Homo sapiens
ccccagcacuuggaguggggagacacaagcuggcagcucccuaagccagaugcugggg

SEQ ID NO: 2251767 - RNA, 81 nt, Homo sapiens
auuucgaucuccuuaauaucugguguaagcuacuguggcuugaguuguauguggcuuuccuagaucuuagggugcagaagu

SEQ ID NO: 2251768 - RNA, 70 nt, Homo sapiens
auagcugcucaggcuuuccucauguuuaaugagcacuggucaggaguuuugaggaaagucccucaguuau

SEQ ID NO: 2251769 - RNA, 56 nt, Homo sapiens
gagacggagucucgcucuuucgcccaggcuggagugcaguggcgagauuucggcuc

SEQ ID NO: 2251770 - RNA, 123 nt, Homo sapiens
cauuuugugguaacugauauuuuuaaaaguagggaaugaugaaguaagugcuuaggaugaugccaguuaucuuaucauuguaauuuuauuucuuuaucaagguauauaacuuaucccaaaaug

SEQ ID NO: 2251771 - RNA, 68 nt, Homo sapiens
cuguugccuaggcuggagugcaguggcaugaucucggcucacugcaaccucugccucccagguucaag

SEQ ID NO: 2251772 - RNA, 76 nt, Homo sapiens
ccuugaguuauuuugucaguaaaauaggucuuugugggcuagcacuggaucuauuucaugauaaccuucacugagg

SEQ ID NO: 2251773 - RNA, 100 nt, Homo sapiens
gaggcaggagaaucgcuugaccccaggaggcaaagguugcggugagccaagaucacgccaucgcacuccauccugggcaacaagagcgaaacuccgucuc

SEQ ID NO: 2251774 - RNA, 56 nt, Homo sapiens
ggagaagauucaaaaagucauauuccagggagugagacugauaggacauuuucuuc

SEQ ID NO: 2251775 - RNA, 88 nt, Homo sapiens
guggggccuggaaguguggaagugucuggggccaggggccugaccacauggcaccuucuuuagagauuuuuaaccaauccauccuugc

SEQ ID NO: 2251776 - RNA, 75 nt, Homo sapiens
agugcugcguggaauacuaugaugguggauaagacauucuguaaauccacagaugguaguuuuggcagaagcauu

SEQ ID NO: 2251777 - RNA, 130 nt, Homo sapiens
ccaauuugauucuucugcaugugaauauacaguuuuccucacaaccuuuauugaagagacugcccuuuccccauugucuguucuaguuguaugugauuaguugacuguaaauguguggaauuauuucugg

SEQ ID NO: 2251778 - RNA, 81 nt, Homo sapiens
gaaucaaaagaaaguuuuaagucuuuuugagaugaauccucacaaacaaaggaguuucacagagggcuucuuucuagauuu

SEQ ID NO: 2251779 - RNA, 66 nt, Homo sapiens
gugguguaucacacuuauugaccugcagauguuaagccacccuugcaucucuggugugaaacccac

SEQ ID NO: 2251780 - RNA, 64 nt, Homo sapiens
ugagaugaacuugauuguuuuaggacuaaauguuuuuauucaauugacaauuagagaucacuca

SEQ ID NO: 2251781 - RNA, 73 nt, Homo sapiens
uguuuauuuuguucccugcuguagcuccagcacuuugagcagugccagagacguagggaauauucaaucaaca

SEQ ID NO: 2251782 - RNA, 68 nt, Homo sapiens
cuguagucucagcuacuugggaagcugaggugggaggaucacuucagcccaggagguugaggcugcag

SEQ ID NO: 2251783 - RNA, 114 nt, Homo sapiens
guggauccaggcugggauucccucuaccuucacaguggugggagacgucaggaugacagucuggggucuuuccacugugggcacaaagaggcuauguuccaguccuugauccac

SEQ ID NO: 2251784 - RNA, 76 nt, Homo sapiens
gggguuggaguuaaguugcagguugugauuccauaggccuggccuggggucugauccugcauuuguaaccagcucc

SEQ ID NO: 2251785 - RNA, 86 nt, Homo sapiens
ccaaaagauuguaaauuuuaagaaugaagucacugaauggcaauaccacuccacaguggcacuauucucagagucagugcccuugg

SEQ ID NO: 2251786 - RNA, 78 nt, Homo sapiens
guuaauagccucauucuucagaugagacaacugagaugcagcaauguuaaguaacuuaucugagauugaccuauugau

SEQ ID NO: 2251787 - RNA, 100 nt, Homo sapiens
gugcauguuuguuacauggguauauucauggguauauugcaacccaacuggucagguuggucuucuaauguaccuguuacccaaauagugaacauuguac

SEQ ID NO: 2251788 - RNA, 130 nt, Homo sapiens
ccaaaauaguuucauuuagcuauacuucuggcuucgucccuuuuggaauccucuuagcuuaugacugauagggcuaugaggagaugauuuaagucuguguaccacuucuaaucuuuacuuacuuuuuugg

SEQ ID NO: 2251789 - RNA, 65 nt, Homo sapiens
agccccugagacuugccucgggcugggacagccauucgccugggccggcagccagucugggggcu

SEQ ID NO: 2251790 - RNA, 71 nt, Homo sapiens
gggguuucaccauguuggccaggcuagucacggacuccugaccucaggugguccgccugccuuggccuccc

SEQ ID NO: 2251791 - RNA, 62 nt, Homo sapiens
cuauuugguuggugaaaaaaguaguggcaaaacccgcaaugacuuuugcaccaaccuaauag

SEQ ID NO: 2251792 - RNA, 62 nt, Homo sapiens
ccagcaauuuuguuuauuuucauuuguccuugcaggauuaugaaagcccuugcaaaugcugg

SEQ ID NO: 2251793 - RNA, 58 nt, Homo sapiens
cagaugagaugagcauuugaauuggggggcccaauaaagaagauugcucucuccgcug

SEQ ID NO: 2251794 - RNA, 63 nt, Homo sapiens
gauauugguuguggguuugccaaaaauugcuuuuguuauuuugaggcauguaccaucaauauc

SEQ ID NO: 2251795 - RNA, 104 nt, Homo sapiens
ucuucuagucauggcagaaggugcagagggagcaggcaugucacauaacaagagagggagccaugugacaagcucccucugcaccuucugccaagauuagaaga

SEQ ID NO: 2251796 - RNA, 90 nt, Homo sapiens
gacacagugagaauugcucaaaucaguacuugagugguucaauguuaaggugaauuucagguacaauuugagccagagguucauaguguc

SEQ ID NO: 2251797 - RNA, 66 nt, Homo sapiens
ugucauugguucuguuuauaugcuggauuacauuuauugauuugcauauguugaaccagccuugca

SEQ ID NO: 2251798 - RNA, 103 nt, Homo sapiens
cccacagugcugggauuacaggcaugagccauggcaccuugucuaaaaagagguauuuuuggccuggcgcgguggcucacgccuguaaucccagcacuuuggg

SEQ ID NO: 2251799 - RNA, 95 nt, Homo sapiens
guuccaaccagagggcugugacuagacuugcaagguugcagggcgaugccauugcuaccacagucaguacacauggaggccacacugagcgggac

SEQ ID NO: 2251800 - RNA, 76 nt, Homo sapiens
auuuauuuugaccauggggcaggagaaaccugggaaggugggaggaagguuggaaagcaacauggccagagugaau

SEQ ID NO: 2251801 - RNA, 57 nt, Homo sapiens
gcacuucuucaucugcugcagaauaauaauaacaccuuguagcaugaugcugagugc

SEQ ID NO: 2251802 - RNA, 128 nt, Homo sapiens
ucuaaauaaaggauuauauuagcuaaaaacgauugaacuugagauaugaguagguaccuuucuaguaucugguuuuguuacagguucuuaugguugauuuucugccuguaauguaguauuuuaauaga

SEQ ID NO: 2251803 - RNA, 100 nt, Homo sapiens
cugguaagggaguguuguuaccaguuauuggaguuguacgcacgcucacuucaugccucaagugagcaugcgcacaacuccaguaaacacacugcgccag

SEQ ID NO: 2251804 - RNA, 64 nt, Homo sapiens
guguggguagaugaauccauuccaaggcccaagguaaauauucagccuucauccuaccucauac

SEQ ID NO: 2251805 - RNA, 98 nt, Homo sapiens
agcauauggucaauuuuggagaauauucuauguggaggugaaaagagaauauauucuacugucauuggauggaaugcucuguaaaugucuaauauguu

SEQ ID NO: 2251806 - RNA, 70 nt, Homo sapiens
cuggggguuuuuaaguaccagaagcaacauuauuucuauauuuuuuguucugccacugaaaaugccucag

SEQ ID NO: 2251807 - RNA, 90 nt, Homo sapiens
uuugacaaaguuuuuuacccugggaagcuuccagucaggucaaauauagccuugcaaguggagcuuccagggccugccaaacaggucaaa

SEQ ID NO: 2251808 - RNA, 58 nt, Homo sapiens
ccucagcuccuaucucuguauggccugguuuuuccuagguuaugauuguagagcgagg

SEQ ID NO: 2251809 - RNA, 73 nt, Homo sapiens
ggccaugguaaggcuuagauaagugaggauauguaaauagcaacugucaacauuuaucaaguuauugugugcc

SEQ ID NO: 2251810 - RNA, 59 nt, Homo sapiens
cugauaguucucuuuagaguuuaggguaggaugauacugaaggacuguagaacuauuag

SEQ ID NO: 2251811 - RNA, 62 nt, Homo sapiens
ucaguuugccaguauuuuauugagaauuuuugcaucaauguucaucagggauauuggccuga

SEQ ID NO: 2251812 - RNA, 68 nt, Homo sapiens
gaaggcaggaacuggauggacucaguugaaagaucucacugggugagauccauguuuauauggcuuuu

SEQ ID NO: 2251813 - RNA, 57 nt, Homo sapiens
uaugaccuuguccccucucgccucugaucaggauggugauguuguggcgaggucgug

SEQ ID NO: 2251814 - RNA, 90 nt, Homo sapiens
acccuccugugauagcagaauaauguccccccaagggauuauccccccggauuauaccccacagggggcauuauacuggauuaucugggu

SEQ ID NO: 2251815 - RNA, 91 nt, Homo sapiens
uacucuuggggaaauauccagauauggaaugguugggucauaagguaggcauauguuugcucaaaaauuccaagaugguuuuuccaaagua

SEQ ID NO: 2251816 - RNA, 87 nt, Homo sapiens
ggguguuaauggccggagcauugggguuuugcaguuuggcaauguuucauggcuaagaugcacacuucacugacccaugccccaccc

SEQ ID NO: 2251817 - RNA, 76 nt, Homo sapiens
cuaugccuacagguaaacauacugcugucuucuuggaagaccgagaaguauaaagaauguuuaugugcaggucuag

SEQ ID NO: 2251818 - RNA, 82 nt, Homo sapiens
uggaacuggcccuggcucaggucauuccaggagggccacagcagcuguccuucaacccaggacccagacagggccagcucca

SEQ ID NO: 2251819 - RNA, 57 nt, Homo sapiens
ggauaaguguuuagagcuuugggaucugauugggugagguguuaagcagacuugucu

SEQ ID NO: 2251820 - RNA, 99 nt, Homo sapiens
gcugaucuguucuuacuucgucaugagacagaugcugaaaccaaaaccuagaaaaguuucuuauccaaagucacauggcaagucaguuccagaaccagc

SEQ ID NO: 2251821 - RNA, 70 nt, Homo sapiens
uugcuugaacccaggagguugcagugagccgagaucguguuauugcacuccagccuggguaacagagcaa

SEQ ID NO: 2251822 - RNA, 78 nt, Homo sapiens
cucucaguuacuugacacaaccaauugaaucuugcucaaggcaguggaaguuggguuugugucaguugcaaccaagag

SEQ ID NO: 2251823 - RNA, 78 nt, Homo sapiens
agcccucauuaucacacgccuugcuucauuuacuuuaucagaaagaaaaugguggugguggugguggugagaauggcu

SEQ ID NO: 2251824 - RNA, 84 nt, Homo sapiens
uuaauuuauuucauuuuuuaaaggacaaaaaaccaaacaccgcauguugguuuuuugguaauugaacaaugagaugggaauuga

SEQ ID NO: 2251825 - RNA, 61 nt, Homo sapiens
uucaggauuuuauuucuccuucgcuuaugaagcuuaauuuggcuggauaugaaauucugga

SEQ ID NO: 2251826 - RNA, 70 nt, Homo sapiens
guggcaaagaugccuucuccaagcacugaaaauuaacugggcauaggcuuggaggggcuguuuugguuac

SEQ ID NO: 2251827 - RNA, 66 nt, Homo sapiens
uauuugucuugagugugcaaguaauugcauaaauuguauacauuuguacacuaagaaucgcagaug

SEQ ID NO: 2251828 - RNA, 101 nt, Homo sapiens
cuuuugcuuuaguuuauagacugguuuauuauacaguuuauuuguaaauuuggcucaucauagaauguauuaguaaauuuguccauaggcagaagccagag

SEQ ID NO: 2251829 - RNA, 74 nt, Homo sapiens
gccgaggaggggaguuacaaucacaggcauuguguugagcucaaugcuaugugugacuucuuauggugcuuggu

SEQ ID NO: 2251830 - RNA, 69 nt, Homo sapiens
uucugcaauuguuuauuucuucagaauuguugguuucucagcagcuuugaucugaaugauuuuguggaa

SEQ ID NO: 2251831 - RNA, 119 nt, Homo sapiens
guagcagaaagaggccaaacuuugauuaagggcucguuagauuccaucauuaaauuaucuacuaguauggaauuugugaccuuauaauuauaauuaaaguuccuucagaccauaacuac

SEQ ID NO: 2251832 - RNA, 59 nt, Homo sapiens
ggcugcuguuucucuuucagcaucgguaucugagaugcugucucugggaaacagcgauc

SEQ ID NO: 2251833 - RNA, 73 nt, Homo sapiens
caugaugccaucucgggaaggaguuucaggcagaggaggcagugagugcaaagguccugagguggcaaucaug

SEQ ID NO: 2251834 - RNA, 129 nt, Homo sapiens
auccauucuacuguuaauaggcauuuagguugauuccauguuuuugcuauugugaauagguauugcaguacuauucacaauagccaagauuuggaagcaaccuaagcauccaucaacagauuauuggau

SEQ ID NO: 2251835 - RNA, 76 nt, Homo sapiens
gcacugaagcauuucgcgcuggaaaggcaugcugcguagggcuucaccugucuguuugcgaaauugcuucaaaugc

SEQ ID NO: 2251836 - RNA, 62 nt, Homo sapiens
ugagaaugaugguuuccaguuucauccaugucccuacaaaggacauaaacucaucauuuuua

SEQ ID NO: 2251837 - RNA, 115 nt, Homo sapiens
gaaaggcuucgugacaaaaccaaggugcggagggccguugggagggcuugaaggaaaccccauuggucucugauuucacagcugucuuccgucucggucugcaacccugucuuuc

SEQ ID NO: 2251838 - RNA, 56 nt, Homo sapiens
gaugugcaaauuuccaaacucuuaaaacagaauaauuaaggggugaauugcacauu

SEQ ID NO: 2251839 - RNA, 56 nt, Homo sapiens
gccuguuuggauuccuggucaguuuuucucacaacaaugccaacauguaaacaggu

SEQ ID NO: 2251840 - RNA, 105 nt, Homo sapiens
ugggaggaugguuugagucugggagguggagguugcagugaugaagugagcugugauugcaccacugcacuucagccuuggcuacagaguaagaccguuaucuca

SEQ ID NO: 2251841 - RNA, 60 nt, Homo sapiens
aucgcauaaucucuaaaaagcaaugauagugaacacaguucaugccagaguuuaugugau

SEQ ID NO: 2251842 - RNA, 72 nt, Homo sapiens
uuucucuucucuagugauuagcaccucauguguaaaacgcaaugaguaugagaauacauuaagagaaagaaa

SEQ ID NO: 2251843 - RNA, 129 nt, Homo sapiens
cuuuucagucaaauaagccaggacaguggaagggaagugacuguaauuacaggaaacaguggugugaagacauugucuagugaauacauuaauguccccacucaugaagcuaauaacggagaaggagag

SEQ ID NO: 2251844 - RNA, 64 nt, Homo sapiens
acauugguuucaugucaugaacuuagaucuugggaucugaaauuucggcaauaugaaccaaugu

SEQ ID NO: 2251845 - RNA, 63 nt, Homo sapiens
caccugcucaccugcgugcuccuucuccugcaagggguuugagcaccaugggcugaguaagug

SEQ ID NO: 2251846 - RNA, 129 nt, Homo sapiens
ccauuuucccauaagcugugugauuuuuauagcaagauuuugcguugcacaguaauuuuuagaaauguauauuucauguuacagcagaauugauugcauuguaggcuuggugaguuugugggaggaugg

SEQ ID NO: 2251847 - RNA, 81 nt, Homo sapiens
uaaaacauuaguuacagaauguacagagguuuaugguuuauuucccagauagcuuguguuuuucuaaguaucugauuuuua

SEQ ID NO: 2251848 - RNA, 62 nt, Homo sapiens
cccagagccucuucaaaacagagcccugacaauuaggcagucugaguuuugaaaggcuuggg

SEQ ID NO: 2251849 - RNA, 88 nt, Homo sapiens
cuuuacaacacaccaggagaguagacugcaacauuguaaugugccacaauauauugcaacauuguaaguuuauauuagguauaggaag

SEQ ID NO: 2251850 - RNA, 67 nt, Homo sapiens
agcagagcccagugaaugacucuggccagagccaccucugcacuuaggagcaucacaggccucugcu

SEQ ID NO: 2251851 - RNA, 88 nt, Homo sapiens
caccauuuguccuuuggcucaguuuccuccgucugcuucucccugaugcagggcccagcacauagcaggaaugggcacagggguggug

SEQ ID NO: 2251852 - RNA, 88 nt, Homo sapiens
aaggguggucuacuacuuaaagauaaggcucgcuuggauuaaagaucauagguuuuguuuuguuuuguuuugagauagucucacucuu

SEQ ID NO: 2251853 - RNA, 84 nt, Homo sapiens
uagcaaaguaggcuuuucugggaugugggcuucauucugguuucugcuaagaaggccaugauccuuaaaaguccacaggugcug

SEQ ID NO: 2251854 - RNA, 65 nt, Homo sapiens
gucucaccuccaaauaucaucacauuggugauuaggccuucaauauaugacauuuggggguggac

SEQ ID NO: 2251855 - RNA, 118 nt, Homo sapiens
gguuuucaaagugagucuuggaccaugauguuaaacuuuuguuuucccugagauuaauagcugucucaauuuagggcuuguuuaacuaucauuaauguccaaacucuccaacaaaacc

SEQ ID NO: 2251856 - RNA, 58 nt, Homo sapiens
cucauuugggagauaauacaugcccacagcacaggguauuguauguaaaccaaaugag

SEQ ID NO: 2251857 - RNA, 111 nt, Homo sapiens
agcauaaaugagagauguugacuaucaugucuggguuuaaggcaauauacaagauucagaguugauaugaccauguagaccucagaguaguuagcaaaucucaugcauguu

SEQ ID NO: 2251858 - RNA, 95 nt, Homo sapiens
guaugacaccucaaagaagcaauacuguuaccugaaauaggcugcgaagauaacaguauuucagauaacaguauuacaucuuugaagugucauau

SEQ ID NO: 2251859 - RNA, 68 nt, Homo sapiens
cucaaacauuucucuugguugaacaguuuggaaacacuuuucuaagaaucugcgaagagauauuuggg

SEQ ID NO: 2251860 - RNA, 63 nt, Homo sapiens
gcagacuagagggaaaugaguugguccugaugacaaaacaacccuuucuuuucucuagucugu

SEQ ID NO: 2251861 - RNA, 59 nt, Homo sapiens
uacguuuuucucaaggacauucuuuugguaucaaaaacugucaagugggaaaacaugua

SEQ ID NO: 2251862 - RNA, 99 nt, Homo sapiens
gaccuuggagcccuccugcugaggagugagaaauugguuuccucugccuuucugugucauggaagccacccuccuuccagccccagaggaucuucuguc

SEQ ID NO: 2251863 - RNA, 72 nt, Homo sapiens
cuauggccgaauuuuucuuuaauaagauggcauuuaagcugagaucuuauggagaaaggugguuggccaugg

SEQ ID NO: 2251864 - RNA, 101 nt, Homo sapiens
ugagacagagucuuguucugucacccaggcuggagugcaguggugggaucucggcuuacugcauucuccgccuccgggguucaagcgauuuuccugccuca

SEQ ID NO: 2251865 - RNA, 69 nt, Homo sapiens
cacuugaaccuaggaggcagagguugcagugagccgagauugugccacuccaaccugggugacagagug

SEQ ID NO: 2251866 - RNA, 79 nt, Homo sapiens
cagagacucaaacagguauagucacuugcccaagaucucaaaacggccaauccagggcaagacaugccugugcccuuug

SEQ ID NO: 2251867 - RNA, 57 nt, Homo sapiens
ucuaucuguuagaccaauuggccccauucuuagguaaguucaucucuaauaggugga

SEQ ID NO: 2251868 - RNA, 68 nt, Homo sapiens
gagcugaucuuuauguaaauucccuuaugcaaauaucccugagggaguuugcuuaccgaagucaguuc

SEQ ID NO: 2251869 - RNA, 66 nt, Homo sapiens
guacacuguaacucuuugagggcagggccauugugauaccugucuuuauuuuauugcagugauuac

SEQ ID NO: 2251870 - RNA, 71 nt, Homo sapiens
cucuaauuaagaucaggaggcuuggguuccaauugacaaagcucuucauuccccugauacuuagucaagag

SEQ ID NO: 2251871 - RNA, 100 nt, Homo sapiens
cacaguccuggaggcuggaaguccaagacuaggaguuggcaggguugauuucuucugagacugcucucuuugucuugcauguggccaccucccugcugug

SEQ ID NO: 2251872 - RNA, 87 nt, Homo sapiens
cagcgugggaccacaugaccgcucaccuccucaucuuccagaaggaccaggagcacaauggucauguggaugggguucccaaugcug

SEQ ID NO: 2251873 - RNA, 81 nt, Homo sapiens
gcgcacaccuguagucacagcuacuugggaggcucaggugggaggaucacuugagcacaguagguuguggcugcagugcgc

SEQ ID NO: 2251874 - RNA, 70 nt, Homo sapiens
guuucauaacaucuuauuggcaaagauauuuaaaucugauaauaucaaguguuagggagaugugggaaac

SEQ ID NO: 2251875 - RNA, 89 nt, Homo sapiens
gcuucuggaaaaucacuaacaaggcaagauacugguugcugacuaggcuacccuuguagucaucauuagucucuuuugcuuccgggggc

SEQ ID NO: 2251876 - RNA, 55 nt, Homo sapiens
auggaguguucugaauccuuuguugucauuucaacaauguucacagcaucuucau

SEQ ID NO: 2251877 - RNA, 70 nt, Homo sapiens
ugcuguuugcacauuucccaagcuacuucaggauuugccuuuucuuagguauuaggaaauaugcuuagca

SEQ ID NO: 2251878 - RNA, 76 nt, Homo sapiens
agugcuguucccagguugcugauggucugggggugcggaucugcaauccaaaucucuggcacugggauguggcacu

SEQ ID NO: 2251879 - RNA, 87 nt, Homo sapiens
gcuuuucuuuauggauagugcuuuugaaucuuguugaagaaauuuuucaacagaguucucgaagauauuuuccauuauuguaaaagu

SEQ ID NO: 2251880 - RNA, 55 nt, Homo sapiens
augaguugaagcuacaagaggcacaagacagaaagugccuaugucuucaaaucau

SEQ ID NO: 2251881 - RNA, 75 nt, Homo sapiens
cauuauauuacagcacuguuaaagauacugaaauauauugaaguuuuaccuugacauugcuguaguguccagaug

SEQ ID NO: 2251882 - RNA, 103 nt, Homo sapiens
uauaccaccugacacugaaucaaguaccagauauaauuucugugcugcugugugaaggcgcaaagauaugucugcuauuugcuguuccuugugauguggugug

SEQ ID NO: 2251883 - RNA, 60 nt, Homo sapiens
gagaaugaugguuuccagcuucauccacgucccuacaaaggacgugaaaucaucauuuuu

SEQ ID NO: 2251884 - RNA, 70 nt, Homo sapiens
cugggauccaugugguuuaagcaguuagagaagacuuuaugaaagauguaagauuacagcuggauccuag

SEQ ID NO: 2251885 - RNA, 83 nt, Homo sapiens
ugggaacaaagucuguuacagcuauuucuguaggaaacugcuacacuccuuaccagaacggguguaacauuuuguaaguccca

SEQ ID NO: 2251886 - RNA, 59 nt, Homo sapiens
uuuauuuggugaucaggcagcccuggguucaaauccuggcucuguugcuaccaauuaag

SEQ ID NO: 2251887 - RNA, 121 nt, Homo sapiens
uacacauacucauggccauccuaguuuuguguccguuuuguuucaggcucagugcauacagaagcaccugagucucaacugggaauugauuuaggaaggagagguuuuggauguuugugua

SEQ ID NO: 2251888 - RNA, 62 nt, Homo sapiens
gaaaauagcacuuauagauuuggucucuaguaccaagagagcugaauucaagugcuggcuuc

SEQ ID NO: 2251889 - RNA, 68 nt, Homo sapiens
aaagccuucuccagccaacacacauuuauuccuccaugaaugaaugcacugcggguggauggggcuuu

SEQ ID NO: 2251890 - RNA, 76 nt, Homo sapiens
uugagguauaaagguagguuguugauaugagcucuuuguucuuuuguaauguacacacuuaucacuuaaacuucag

SEQ ID NO: 2251891 - RNA, 84 nt, Homo sapiens
cuuucaugguggguuccugagacugaggagcuuuggacggaugcuuggcuguugggaaugucccagucacaggacacuguaaag

SEQ ID NO: 2251892 - RNA, 58 nt, Homo sapiens
gggaauauaaaaagccccagaaugaugccugugugauuugggggcaauuuaugaaccc

SEQ ID NO: 2251893 - RNA, 82 nt, Homo sapiens
guccuugcuauugugaauggugccgcaauaaacauacgagugcaugugucuuuauagcagcaugauuuauaaucguuugggc

SEQ ID NO: 2251894 - RNA, 81 nt, Homo sapiens
auguuauugguaaggcuucuggucaacagcaggcuauuagcaguuaagccuacuauugaccagaagccuuaccaauaacau

SEQ ID NO: 2251895 - RNA, 64 nt, Homo sapiens
ggaauugccauagagacucaacagccuuuguaaaagcagagggaaguggcucuauggcaacuuc

SEQ ID NO: 2251896 - RNA, 98 nt, Homo sapiens
aggcaggagaaucacuugaacccgggaggugaagguugcagugagcugagauagugccauugcacuccagcccgggugacaagagugagacucugucu

SEQ ID NO: 2251897 - RNA, 60 nt, Homo sapiens
uugguuccauauuaauuuuaggauuauuuguucuaguucuaugaagaauuauggugccaa

SEQ ID NO: 2251898 - RNA, 82 nt, Homo sapiens
augccuuuauuucuauuucuugcuuaauuucucggcuaaaaccuucaguguaauguugaguagaagugaagauagugggcau

SEQ ID NO: 2251899 - RNA, 75 nt, Homo sapiens
gggugagcacagaaugcccugagugaggagcacaagucacuccaggccucagcuccgggcuccugagugucaccc

SEQ ID NO: 2251900 - RNA, 80 nt, Homo sapiens
gauguuucauccccuccaaaucucauguuaaaaugugauucccuuguuggaugugggguuuggugggagguguuugcauc

SEQ ID NO: 2251901 - RNA, 93 nt, Homo sapiens
aguaaguuggugccuaaguaauggcaguuuuugccauuauuuucaauggcaaaaacugccauuacuuuugcacuaacccaaauaaaauuuacu

SEQ ID NO: 2251902 - RNA, 62 nt, Homo sapiens
accuccucugggccugguguuuguggcaucuguggcaguuugaauaacagccccagggaggu

SEQ ID NO: 2251903 - RNA, 101 nt, Homo sapiens
agaaggaagaguagugugaauauuugguuauggucauggacaccuggggaccagccuguguccuugcccauauuuccaaaggucacucuuuuuuuuuuuuu

SEQ ID NO: 2251904 - RNA, 80 nt, Homo sapiens
aggugugucuuguuuauagcuuucuguccauagucccuaaaucagagaaaauucuauaaagaccuuauaaugauauaccu

SEQ ID NO: 2251905 - RNA, 75 nt, Homo sapiens
agaaaaauuuuugagguauugauaaaacauuuauguuuaugcaugggugcauguguguauacucaaaaacuuucu

SEQ ID NO: 2251906 - RNA, 88 nt, Homo sapiens
aggcaguggguucccuucuggcucaggguguaucuagaaauguuguauaguagcuauggccuagaaugggggccucaugacucugccu

SEQ ID NO: 2251907 - RNA, 83 nt, Homo sapiens
uuguauaauaaauugcucagaagcugaaauuugaccucagaugacauugaguucaaaucucagcucuguuauuuauggagcag

SEQ ID NO: 2251908 - RNA, 61 nt, Homo sapiens
gcaucugugguucuagcuacuuuggagacugagcuuggaggauugcuugaacccagaaggc

SEQ ID NO: 2251909 - RNA, 76 nt, Homo sapiens
gguccuggucaauuguaccaucauuauacguagaaauuauguucugaauucuacuugaguguuggugacugggauc

SEQ ID NO: 2251910 - RNA, 56 nt, Homo sapiens
uuauugcucauuugggcauucuguugaugggccagcaauguugggaugaguaauaa

SEQ ID NO: 2251911 - RNA, 57 nt, Homo sapiens
cgagcucguccgggucgcgcaggggccgggggucuuugugcuccagagacgggcucg

SEQ ID NO: 2251912 - RNA, 97 nt, Homo sapiens
uuauuuguuuauuaucuguuggguuauugcuggaucccuagucucuagaacagcacuuguuuucauaguagucacuuaauaaauaauacauggauga

SEQ ID NO: 2251913 - RNA, 71 nt, Homo sapiens
gaugacuaaugccauggcccaccaggucagggccaugcuacugaccugaaggccauggaacaguggugguu

SEQ ID NO: 2251914 - RNA, 102 nt, Homo sapiens
cccaaagugcagggauuacaggcgugagccucuguguuaaaaauacuuuggaguauauaggccaggcacgguggcucacgccuguaaucccagcacuuuggg

SEQ ID NO: 2251915 - RNA, 72 nt, Homo sapiens
cauugucuuuugguggcauuuauaaagcccccaccugugggagcuuaguacuaaaugucauacaaagcaaug

SEQ ID NO: 2251916 - RNA, 106 nt, Homo sapiens
uggccccugugcacguguggcucucagaggcuccaggucaugauuuccuuguggacaucccuugacguggagucucugggcccacuuaauucucccauaaaggcca

SEQ ID NO: 2251917 - RNA, 103 nt, Homo sapiens
uuugggccaguuucuuacauucuuugggccacuuuaguuuccuuauugaaaaauggggauaauaauaguggcuacaucucagugugauucugaggaaaccaga

SEQ ID NO: 2251918 - RNA, 97 nt, Homo sapiens
cacggauccccaccccuggcuuuuagaaggcugacugacacauugcgugucaguuaaugcugccugcuggaagccuggggcuuugccggggacugug

SEQ ID NO: 2251919 - RNA, 65 nt, Homo sapiens
cuguugucugugcugagaguugaaaguugcagccuugucccaaccucacucucaggcagacgcgg

SEQ ID NO: 2251920 - RNA, 56 nt, Homo sapiens
uaagaugaaggcucaccuagaacucaagugaccauucagagguuagcaucaucuua

SEQ ID NO: 2251921 - RNA, 55 nt, Homo sapiens
gugagucaugucccaucugauuuauauuggaucuggcuguggagccaugacucac

SEQ ID NO: 2251922 - RNA, 86 nt, Homo sapiens
uauucuacugucuaugucuuggaaaguuguuguaguuauuauuuuugauuaguacaugauugaaucuuucuaugaagauaagagua

SEQ ID NO: 2251923 - RNA, 105 nt, Homo sapiens
ucagccuggugucuauaagacugguacuuugacuuuagacacagcgggggaugggcugcccccuccuuggucaaaaagaaagugucuaucugaugccaugacuga

SEQ ID NO: 2251924 - RNA, 85 nt, Homo sapiens
uauuggguucauuauuggaauuaaccuggugcuggauauuuucaaauuguaucuagugcagcugauuuuaacaauaacuacugug

SEQ ID NO: 2251925 - RNA, 96 nt, Homo sapiens
gguuagaggaucgcuugagcccaggauuugaggcugcagugagcuacgaucacaucauugcacuccagccugggugacagagcgagacccuauauc

SEQ ID NO: 2251926 - RNA, 101 nt, Homo sapiens
ugagacggagucucacucugucgcccaggcuggagugcagugacgugaccucagcucacugcgaccuccaccucccggguucuagcgauucuccugucuca

SEQ ID NO: 2251927 - RNA, 114 nt, Homo sapiens
gguucaucaagaggcugagggauccaguuguggcuccgauguuugggugcccuugggauacccgggaggcaggagucauagauuuggagcgucccgaguggccagacgagagcc

SEQ ID NO: 2251928 - RNA, 76 nt, Homo sapiens
acuuaguaguaucuuaggccuucaguggaaggaaacagcauguuccacgcccuguagcauccaagaagcugcaagu

SEQ ID NO: 2251929 - RNA, 63 nt, Homo sapiens
ggucucuugguuuagagcauuuagggccaaacugcuggcaugguugacccuaagcuggagauu

SEQ ID NO: 2251930 - RNA, 58 nt, Homo sapiens
gcgguggugugggugggggaggugcugaggcugcagugauccuugauugcaccacugc

SEQ ID NO: 2251931 - RNA, 57 nt, Homo sapiens
gagccaagaucgcgccauugcacuccaaccugggugacaagagcgagacuuggucuc

SEQ ID NO: 2251932 - RNA, 72 nt, Homo sapiens
gaaagauggaagguuguuucuggaagcuguuagguuuuguuaaggcagagauaauacauuuucuuuucuuuu

SEQ ID NO: 2251933 - RNA, 81 nt, Homo sapiens
aaaaucuggcuaagugcuugagugugcugcacuauguguuugcucguguguaaaguggcaugcuuacaacuggccuguuuu

SEQ ID NO: 2251934 - RNA, 74 nt, Homo sapiens
augaagggauguuaaauauuaucaaaagcuuuuucagugcacauugaaaugauuauaugguguuugcccuuuau

SEQ ID NO: 2251935 - RNA, 71 nt, Homo sapiens
ucucugaaccugaguuuccucaucgauaaaaaguggguaauccuacuuuguagagugugagaauucagaga

SEQ ID NO: 2251936 - RNA, 55 nt, Homo sapiens
cucacuaggaaguaaaguuuguaagcccaaggccaauaugcuaauuuuuaguggg

SEQ ID NO: 2251937 - RNA, 66 nt, Homo sapiens
uugaaugggaggcggagguugcagugaacgaagauugcgccacugcacuccagccucccgucucaa

SEQ ID NO: 2251938 - RNA, 82 nt, Homo sapiens
aguuuuaggguacaugugcacaaugugcagguuuguuacauauguauacacgugccauguuggugugcugcacccauuaacu

SEQ ID NO: 2251939 - RNA, 66 nt, Homo sapiens
gccacugggccuugccuacuuauguaauuuuuaaaaauuacaugucuugguaagguuagaaguggc

SEQ ID NO: 2251940 - RNA, 75 nt, Homo sapiens
ugaucaauuuggaggagguugguaccaucuguuugggguucuuuaaaucaaguacuaaucucucugaauuuguca

SEQ ID NO: 2251941 - RNA, 69 nt, Homo sapiens
ugcauccucucaacaaugugugggguaauaagggcaaguauuaaaccacguuuacauuugagaaaugua

SEQ ID NO: 2251942 - RNA, 63 nt, Homo sapiens
uuugacuuuuauucacucugcuacauuauugggacagugcuaagggagagagagaaaguuaga

SEQ ID NO: 2251943 - RNA, 72 nt, Homo sapiens
uggguauauuguaugaugcugagguuugggguaugguggauuccauaacccagauacugagcauagcaccca

SEQ ID NO: 2251944 - RNA, 64 nt, Homo sapiens
gcaggcuuagaacgaggucuagggguagccuccaggcacccgugacgcugucugaaaugcuugc

SEQ ID NO: 2251945 - RNA, 86 nt, Homo sapiens
cauucaguaugauauuggcuguggguuuaucauaaaaauagcucuuauuuugagauaucuuccaucaguaccuaguuuauugagug

SEQ ID NO: 2251946 - RNA, 88 nt, Homo sapiens
uaucugccacgagcacggugacaguaggguggcacaugagccacuuauuugccacugcaggcuguuuaaccucgcuauucugcagaua

SEQ ID NO: 2251947 - RNA, 113 nt, Homo sapiens
uuucucuaacaacccaagaauuguuagcaauuguuaguaguugggucuaacaacccaagaguuguuagcagcucuaauaacugcuacaagcacuuaaaauuuuuaaggagaaa

SEQ ID NO: 2251948 - RNA, 87 nt, Homo sapiens
uucacuguuguauccccagcaucuaguacaacuacugguauauaauaaguacacaguaaauauguauugaaugcauagacuagugaa

SEQ ID NO: 2251949 - RNA, 56 nt, Homo sapiens
aggaacucuagauuuuagucuaucuccaaauuuauggauggauuggaaaaguuccu

SEQ ID NO: 2251950 - RNA, 78 nt, Homo sapiens
acauauuuacagucuuuauugguuuauccacaauuuuugcauauguggcaauaauucagugugggcuaaguuauaugu

SEQ ID NO: 2251951 - RNA, 85 nt, Homo sapiens
uaguucacaugagagcugguuguuuaaaggagccaggcaccuccuccucucucucuugccccagcucucaccauguaauguacug

SEQ ID NO: 2251952 - RNA, 56 nt, Homo sapiens
aaaauagaggcuuccuuuaaaaagcauuccuuauuagguaggauagucuuuauuuu

SEQ ID NO: 2251953 - RNA, 67 nt, Homo sapiens
gugggguaaggagcaaauaucuuuuuagcuccuagggaaggagcugaaguuuccauuuguaccucac

SEQ ID NO: 2251954 - RNA, 55 nt, Homo sapiens
cucuuugaggugagcugcccaucggagccuuccgggagucucaccugacaaggag

SEQ ID NO: 2251955 - RNA, 56 nt, Homo sapiens
ggucauagagaauucaccaggaucuaaaucuugaaugcuggugagcucauguggcu

SEQ ID NO: 2251956 - RNA, 75 nt, Homo sapiens
agaguaaggcuuugucuuaggacuuuuguguccuuugguuuuuuggcagcagaguccagggucaagguccacucu

SEQ ID NO: 2251957 - RNA, 60 nt, Homo sapiens
uguaccaauuugagagccucaagcaucaccuuuguaugagucuguucucacauugcuaua

SEQ ID NO: 2251958 - RNA, 72 nt, Homo sapiens
aaaagcuaagguagcauuggagaccuccuaagaauuuuauuagguggaucucaugaugauuauuuuacuuuu

SEQ ID NO: 2251959 - RNA, 60 nt, Homo sapiens
cucuuuaaaaaggaugcacuuugacauuuuaaaauaucuaugugcauaguuauuaaagag

SEQ ID NO: 2251960 - RNA, 74 nt, Homo sapiens
ggaauaaaaaauggcuauuccauaggcagagcaauggcuugagcugcucaacuaaggauacuuauuauuauuuc

SEQ ID NO: 2251961 - RNA, 72 nt, Homo sapiens
uaucugaagucagacuagccacauuucagggacucaauauccaccuguagcuaguggcuacugaacuagaug

SEQ ID NO: 2251962 - RNA, 91 nt, Homo sapiens
gggagauaauuuagcuuuagcugugugaaccuagcagcuaucauguuauucacugauaucugaauagauacacaaugaggcauuuacuucu

SEQ ID NO: 2251963 - RNA, 75 nt, Homo sapiens
acuuauaagacaggacauuuuuggauggauuagaugcguaggcaucccugaaccccagaaaucucuaaucuaggu

SEQ ID NO: 2251964 - RNA, 85 nt, Homo sapiens
ugauuauguugauucugugaauuucuacagggcagguauuuuuucucaauuaagccauuucugagguucacagagguuaugauua

SEQ ID NO: 2251965 - RNA, 58 nt, Homo sapiens
gcuggaaugugggaagugaaggcugcauugagccgagaucgcaccacuauacuccagc

SEQ ID NO: 2251966 - RNA, 82 nt, Homo sapiens
aguucuagggugcgugugcacaacgugcagguuuguuacauguguauaaaugugccauguuggugugcugcgcccauuaacu

SEQ ID NO: 2251967 - RNA, 85 nt, Homo sapiens
ggagaaucgcucaaacccaggcagagguugcagugagcugagauugugccacugcacucuagcauggguaauaaagcaagacucc

SEQ ID NO: 2251968 - RNA, 61 nt, Homo sapiens
uuggcauuuuggacacccaggaggauugauaguauaguuauagucugaguccaaaggccag

SEQ ID NO: 2251969 - RNA, 85 nt, Homo sapiens
caugcuagauucuccuagcaucaauucauguuaugauuuuaaccaagugucaacagauaauugaaugcuaucaguuacuggcaug

SEQ ID NO: 2251970 - RNA, 89 nt, Homo sapiens
ugaacugaggucacugguagaugcuuaagguguacauaugugugugugacucaguacaguuuucaguguucacugaacacuucaguuua

SEQ ID NO: 2251971 - RNA, 65 nt, Homo sapiens
uauaugcuaaacaaggggugggcaauucuuggaaaugaguguuccucccccuuuuagaccauaua

SEQ ID NO: 2251972 - RNA, 80 nt, Homo sapiens
gguagauaucuucuguggggcagguguacuccacaaacugcuugugaaacugcuggaaugcucuccccacggacucugcc

SEQ ID NO: 2251973 - RNA, 71 nt, Homo sapiens
gaggcuuucuggucuaaaggcacaggcaagggaguguuggccauuugucuccuagacgaccaggcggccuc

SEQ ID NO: 2251974 - RNA, 58 nt, Homo sapiens
ggugucucagugcgaaucucaaagaauugcauuucuuugacuggugauauugagcauu

SEQ ID NO: 2251975 - RNA, 108 nt, Homo sapiens
gaucaucagacauuagauucuuaaaaggagcacacaacauaggucccuugcaugcacaguucacgauacgguuugugcuccuaugagaaccuaaugcaacugcucauc

SEQ ID NO: 2251976 - RNA, 76 nt, Homo sapiens
uacauaagugcaugauuacaugcauaugcauauaaacaugcagccaugcauauguaugaaugaaugcauaggugug

SEQ ID NO: 2251977 - RNA, 128 nt, Homo sapiens
auagucuggcaguuccucaaacaguuaaacauagaguuaccaugucucaguccauuuguguugcuauaaagaaguaccugagacuggugauuuaugaagaaaaguuggcuuaugguuuugcaggcugu

SEQ ID NO: 2251978 - RNA, 60 nt, Homo sapiens
gugagcacaugcuguuggaaaaaaugguacuaacagacuuguucaaugcagcauugccac

SEQ ID NO: 2251979 - RNA, 95 nt, Homo sapiens
aaagaaaguuauauauaugaagauuuuuuguaaggaaggcuauaaaggaaagauaaucuuugaugagaaaauacuuuguaggguaaauuuuuuuu

SEQ ID NO: 2251980 - RNA, 83 nt, Homo sapiens
guuuuauucauaugauuuggauaguucuucuacuagagugugauagcacucauagaacaggggaauuaucucauaucuggaac

SEQ ID NO: 2251981 - RNA, 58 nt, Homo sapiens
uggugggagugacguugccuucuaugcauagcaguguugcaaaguuuagcucccacua

SEQ ID NO: 2251982 - RNA, 84 nt, Homo sapiens
agguaaaagcuauaauucuccuugccugauagcaaaguugcaggcaagaagaacuauaacuuuuuaaaauuaucaacuagaccu

SEQ ID NO: 2251983 - RNA, 81 nt, Homo sapiens
uuuucuaguucuuuaacaugcaucauuaggugguuuauuugaagaauagaaccuaaugaugcaugagacagaacuagaaaa

SEQ ID NO: 2251984 - RNA, 75 nt, Homo sapiens
gagaauguggcaggaggugaugcuuggggacuucgaagcuacaucaucaaaagcaacacaucugccccgguucuc

SEQ ID NO: 2251985 - RNA, 67 nt, Homo sapiens
cagguggugccucagggacuuacaaaccagaagguuccaugccuuccccuuuaguggguauuauuug

SEQ ID NO: 2251986 - RNA, 86 nt, Homo sapiens
auguuucuauggaucuuucugcuuuugaauuacauggccugaaaaugaaguaaucugaaagcuaggaguucucaugcauaaaacau

SEQ ID NO: 2251987 - RNA, 105 nt, Homo sapiens
gaggccccuuuauucuggcagcucuuuuauuccaguugccacauguacacuagagagaugucugaugauguuggaaacuuggugcggcugccccuuggaggccuu

SEQ ID NO: 2251988 - RNA, 63 nt, Homo sapiens
aucuaugcuucuuaaauuaguuaugcaauuacaaaagaaagcaugauucauugaaguuuagau

SEQ ID NO: 2251989 - RNA, 79 nt, Homo sapiens
gacaggcacagcuguaguuuauucauguuaaauaauucauaauauuuguugcaugaauagcuuuagcccauguucuguu

SEQ ID NO: 2251990 - RNA, 69 nt, Homo sapiens
gguaccuauggcagccacggccuggagauugugaugcucagcuuccacggccggcgugccaggggcacc

SEQ ID NO: 2251991 - RNA, 65 nt, Homo sapiens
guauuucuaguucuagaucccugaggaaucgccacacugacuuccacaggguugaacuaguuuac

SEQ ID NO: 2251992 - RNA, 64 nt, Homo sapiens
gcuuauauuaucaucauuggcaggugagaaauucuucucuuucuacagugugauuguguaaagu

SEQ ID NO: 2251993 - RNA, 84 nt, Homo sapiens
cagguuaugcuaaauuuuaauacugcuauuguaggaaaaaauauauuuuuguuacagcagaauugaaagagaaccuaugacuug

SEQ ID NO: 2251994 - RNA, 110 nt, Homo sapiens
gcucccacaaaagucccgaguuucacugugguuggaaggcuuaagccaagugcuuacucuugaaccaaucacuguggcuuaggcugcuucaugugauccacacccggagc

SEQ ID NO: 2251995 - RNA, 117 nt, Homo sapiens
gaaggggucaggaguagagaacgggucugcugugcuuugagcagaggccagacucccaagucuggcuucugacuuaggggaccauccgcuucccaucuucccucucuuucuaccuuc

SEQ ID NO: 2251996 - RNA, 70 nt, Homo sapiens
ucagcacucuuaguuugucucagcaacuggauagcucugugcagguacuugacaacuugggcucugcuga

SEQ ID NO: 2251997 - RNA, 82 nt, Homo sapiens
ugugaucgcagcucacuggagccucgaacuccuggacucaagugauccuacucccucaggcuccccaguagcuggaacuaca

SEQ ID NO: 2251998 - RNA, 82 nt, Homo sapiens
aguucuaggguacaugugcacaacaugcagguuuguuacauauguauacacgugccauguuggugugcugcacccauuaacu

SEQ ID NO: 2251999 - RNA, 82 nt, Homo sapiens
aguucuaggguacaugugcacaacgugcagguuuguuacauauguauacacgugccauguugguaugcugcacccauuaacu

SEQ ID NO: 2252000 - RNA, 75 nt, Homo sapiens
guaguggguguuaggacacugugggugggucacccugaagguggaucuuccucucgcaguccuaauccccacuac

SEQ ID NO: 2252001 - RNA, 75 nt, Homo sapiens
gcugggaaacguucaugcagacacacauggaacucaauuagacugggucagugugauaucugcaggggcucuagu

SEQ ID NO: 2252002 - RNA, 73 nt, Homo sapiens
cacuguaauucuuggggcugcucugacaauuaacaaacacaaauguccacguagcaccuuagcauuucuagug

SEQ ID NO: 2252003 - RNA, 63 nt, Homo sapiens
uucugcaggcuuuacagaaagcauggugcuggcaucugcucagcuuuuugggaggccuuagga

SEQ ID NO: 2252004 - RNA, 72 nt, Homo sapiens
ugaguuggaauguauugcuacuucuucgaaucuuggaagaguuuguguagaauugguauuauuucuuccuua

SEQ ID NO: 2252005 - RNA, 59 nt, Homo sapiens
gcuuggagaacguuuucuagaaaaggguuagcuuccuguuggcaugaaauuuuccaagc

SEQ ID NO: 2252006 - RNA, 67 nt, Homo sapiens
acuggcucucaaugucuagcagagaauuggacauguaaagcccuuugcaaaacauugagaccucggu

SEQ ID NO: 2252007 - RNA, 77 nt, Homo sapiens
aaaggguagagguuugauauguggaauauuuaucucagauuauugagauggagaaugacaauuaagguuuuccuuuu

SEQ ID NO: 2252008 - RNA, 56 nt, Homo sapiens
agggagaugaaaucaucagggugugccaauggcauucuuuggugagucaacuccuu

SEQ ID NO: 2252009 - RNA, 105 nt, Homo sapiens
uuguuuucaggaggacuuucgacugcauuuuagaaauauuucaagaauuauggauuguguugguuguuuuaaaugucgucuguggggaaagcuucagguaagcaa

SEQ ID NO: 2252010 - RNA, 58 nt, Homo sapiens
uguccagggauggggucagggacggguuuggcuguugccuagaugcugcccugggaca

SEQ ID NO: 2252011 - RNA, 57 nt, Homo sapiens
guguccucgaguacacaucagggucucagccucggccacgugugucugugaguacac

SEQ ID NO: 2252012 - RNA, 75 nt, Homo sapiens
uuagguacuuaagaucucagcuaugcaaugagggucagcaacacuaaauguuagcagggauacaaggucgccuaa

SEQ ID NO: 2252013 - RNA, 115 nt, Homo sapiens
cagauuagggcagcauuagauucucauaggagugcaaacccuauugugaacuguguaugugagggaccuaguuugcaugcuccuuaugagaaucuaacuaaugccugacgaucug

SEQ ID NO: 2252014 - RNA, 112 nt, Homo sapiens
acucuuacaacauggauuacgcaacuauagagcaagcccaugaaaccuaaaguacauuccaugauacguuacuucacugggggcauuaguagguaguccaugaaugaagggu

SEQ ID NO: 2252015 - RNA, 65 nt, Homo sapiens
gaugggucccagugaaaccccaccuucaggccauggacggccugagggcugggcacugggcuguc

SEQ ID NO: 2252016 - RNA, 96 nt, Homo sapiens
cuuuuguagaugugauuacauuaagaauuuugagaugggagacauuauuuuugauuauccagaugggcuuaauguaaucauagaaauccuuaaaag

SEQ ID NO: 2252017 - RNA, 70 nt, Homo sapiens
gguaaauaaagccugucucuuuagaguauaacauuucaaagugcuucggugaauugcaggcuuuaagacc

SEQ ID NO: 2252018 - RNA, 92 nt, Homo sapiens
aguaaaaacagacccuuuuugaacaguagcuuagguguggguacacaaauacacaguuucuagacccauuguucagagaguggaguuuuacu

SEQ ID NO: 2252019 - RNA, 63 nt, Homo sapiens
ccucagugcaggaauuuccuuagaaacauuacaaauggcucuaaauucuuuccuggguugagg

SEQ ID NO: 2252020 - RNA, 126 nt, Homo sapiens
guccucauccgcccuccuccuccucgccggccugagugagguucuacucugugaccuagugccuucuuguuacagcggaagccaucaccuggaugccuacgugggaagggaccucgaaugugggac

SEQ ID NO: 2252021 - RNA, 67 nt, Homo sapiens
uaccaaguauuuucacaugaacaggguagguuuuauauuaacccauuuuucauaugaagaacuggua

SEQ ID NO: 2252022 - RNA, 102 nt, Homo sapiens
ugaaaaaauaugugcauauaucaguguaugcuucuauuuuugguauguguguuuauaaauuagaucauaguguauauacugcuuugcaacuugcuuuuuuca

SEQ ID NO: 2252023 - RNA, 78 nt, Homo sapiens
aagagaagggauuucauuuccaagacuagucuauaaaaagacuguggccucaucuuggguggauucauucuuucucuu

SEQ ID NO: 2252024 - RNA, 73 nt, Homo sapiens
ggggugagauuauugucucccucaccaggagccuugaaauuggccucugggacuacacugaucuccucacucc

SEQ ID NO: 2252025 - RNA, 55 nt, Homo sapiens
agugcauugagacuugugaguucaugcaaauguauucaaauagcugcagugcacu

SEQ ID NO: 2252026 - RNA, 75 nt, Homo sapiens
gccaacauuuugcaguuucugucuccagggcauuugaugcuucuggguauggggaaggagacugaagaucugggc

SEQ ID NO: 2252027 - RNA, 69 nt, Homo sapiens
uuggagccagggagguggaggcugcagugagcugauaucacacuacugcacuccaguuccgggcaacag

SEQ ID NO: 2252028 - RNA, 85 nt, Homo sapiens
ugcuuguagagauauaauuuuguuuugugguguaauucaggcugcauuccaguagauggcacuuaagagcaagagccuacaggua

SEQ ID NO: 2252029 - RNA, 69 nt, Homo sapiens
uccaaguuagugacauugcugggaaugcuguaauucaucacagcagggcuauagaaugucauggcugga

SEQ ID NO: 2252030 - RNA, 64 nt, Homo sapiens
ucuguggcauuuuggcugugguggagagcucaugaaucuacacaugugaaaaaaauguuacagg

SEQ ID NO: 2252031 - RNA, 72 nt, Homo sapiens
ggguagggacuaucaugauucccaauuuacagguaauagaacugaagugagaugcaguggaguuccuugccu

SEQ ID NO: 2252032 - RNA, 62 nt, Homo sapiens
ggauuuaucugcucuucgcguugaagaaguacaaaaugucauuaaugcuaugcagaaaaucu

SEQ ID NO: 2252033 - RNA, 88 nt, Homo sapiens
aauaucaggagguggggcucacuggggccaucuugaagguaguagccagcuuucaagauggcaccagugagugccaccucuugauauu

SEQ ID NO: 2252034 - RNA, 97 nt, Homo sapiens
auccuuaacgaucagcucaaaugucauuuacccuggaaggcuuuccugagucagggaccccggguggauguacaugugaacucgcacagccuuggau

SEQ ID NO: 2252035 - RNA, 63 nt, Homo sapiens
cuauguguccauguguucuuaggauuuagcucccacuuauaaaugagaacaugugguauuugg

SEQ ID NO: 2252036 - RNA, 55 nt, Homo sapiens
cuggugcccucgcugaugagugggcacugaaggagcaccucagcgagggagccag

SEQ ID NO: 2252037 - RNA, 67 nt, Homo sapiens
augucugaguggggaacaagccaugcacauccaggaguugagaaguuuggcccccagcucaggacau

SEQ ID NO: 2252038 - RNA, 73 nt, Homo sapiens
aagacaugagauuugggaggggccagaggcagaaugauaugguuuugcuugguccccacccaaaucgcaucuu

SEQ ID NO: 2252039 - RNA, 79 nt, Homo sapiens
aagacugggcauuuuuaacaaguuacaggugaugcugauguucauggucccugaacacauguugagaaguacuagucuu

SEQ ID NO: 2252040 - RNA, 85 nt, Homo sapiens
uugcugaagauuuucuaguacucccuggagcuggacgugggauauugcacugccagcccucaugagacugguuaaguuucugcag

SEQ ID NO: 2252041 - RNA, 97 nt, Homo sapiens
gggauauuuggcacugucuguagacauuuuugguugucacaacugggugggaggcaaggugcuacagacagugaguguguaagaggccaggaauccu

SEQ ID NO: 2252042 - RNA, 82 nt, Homo sapiens
ugguuaaguggguuggguccaaggucccuguucaaugugcagccuagagacuugguaucuugcauccaagccacuccagcca

SEQ ID NO: 2252043 - RNA, 59 nt, Homo sapiens
uccucugaaaucuagauugugaugcaauguauacguucucuaaaucagauuucugagga

SEQ ID NO: 2252044 - RNA, 60 nt, Homo sapiens
gucaauucuaaguaccucauauaaguggaaucacacaguauaugucuucuuguaauuggc

SEQ ID NO: 2252045 - RNA, 81 nt, Homo sapiens
uuuauucaaacucuuuguuuuccgaagauacauggaauacaaagcccgaagcugguggagagcaaagaauuuguuaguaaa

SEQ ID NO: 2252046 - RNA, 69 nt, Homo sapiens
ggggaauuucauuauucuuuccugacuaccuaacacaugucagaauuuggaaaguuaaggaaauacccc

SEQ ID NO: 2252047 - RNA, 77 nt, Homo sapiens
cuagggaaaaugucauuuccccaagaucucuaaugauucugucaaagaaucauuagagaucuuggggaaaacccugg

SEQ ID NO: 2252048 - RNA, 129 nt, Homo sapiens
aaugauauuucuagacacaccccuggccagaaggaaggccacugcugccagaacuuuguccagaacuuuguccuuuccuucaaggcaguggccuuccuucuggccaggggugugucuagaaauaucauu

SEQ ID NO: 2252049 - RNA, 70 nt, Homo sapiens
uggcaagggagaggggagacaauugagggcacagcaggugguuuuagcgccuuucuuccucuccuuucca

SEQ ID NO: 2252050 - RNA, 88 nt, Homo sapiens
ggagaaucucuugaaaccguaaggcggagguugcagugagccgaaauugcgccacugcacuccagccuggacgaaagagcaaaacucc

SEQ ID NO: 2252051 - RNA, 97 nt, Homo sapiens
ggacucuuccuuucaugaaagguuucucuguagcauaugaugcuguuugaaagcauuuuacucacaguagagcuucuuucagaaauggagucagucc

SEQ ID NO: 2252052 - RNA, 55 nt, Homo sapiens
ucaugaaguaguuaacugguugcuuuguaauguugacuuuguaauugcuuuauga

SEQ ID NO: 2252053 - RNA, 130 nt, Homo sapiens
gagcagaggaagaaacagcggaccaguuuauaaagcuacagagcggaaaauuucuguugcuguccaaacuaaguuuuuggcuuucugugaagcuuggaaagacuuauacugauguuuuaaucaccuguuu

SEQ ID NO: 2252054 - RNA, 63 nt, Homo sapiens
gucauaucuagacuagacccaaauugaagcuacaguggcuucaguuugggucuagucuuugac

SEQ ID NO: 2252055 - RNA, 73 nt, Homo sapiens
uugacuucagagcugauucaagccuuggaguaauuucaucccuccuuacucacuugaaucuaguggaagucaa

SEQ ID NO: 2252056 - RNA, 68 nt, Homo sapiens
cuguaaccuccaccuccuggguucaaaugauuauccugccucagccacccauguaggugggauuacag

SEQ ID NO: 2252057 - RNA, 61 nt, Homo sapiens
cuagauuuucuuuucaaacaguggcagacauucuguagcuguauuguugaaggaaauguag

SEQ ID NO: 2252058 - RNA, 55 nt, Homo sapiens
uugagauggagucucacucuuuugcccaggcuagagugcaguggcuugaucucag

SEQ ID NO: 2252059 - RNA, 101 nt, Homo sapiens
uagcugcuaccucucacaaauuggcaaucgucuccauuuuuacacccuauauggaaugcaaaaauagaggggauugucaguucuaugaggugcugcagcua

SEQ ID NO: 2252060 - RNA, 89 nt, Homo sapiens
ggagaaucacuugaacccaggaaguggagguugggaugagccaagaucaugccauugcacuccagccugggcaacaacagugaaacucc

SEQ ID NO: 2252061 - RNA, 68 nt, Homo sapiens
acauagcagguguuccacaaauauugguuaccuuacugauaaccaauguaguugaauauuugcuaugu

SEQ ID NO: 2252062 - RNA, 125 nt, Homo sapiens
gguaccugcagugauguauauuuuaaggcuuagauucauuuuagcaaaaguuaguuuucuguaaauugcauucuagcucgcuguaaaaugaauucuaaguucucuuaguguuccacugcuguacu

SEQ ID NO: 2252063 - RNA, 63 nt, Homo sapiens
acugguccuagaguguaguuuucuuaggagauguuucucuuaagauuuagacauuuuagcggu

SEQ ID NO: 2252064 - RNA, 61 nt, Homo sapiens
uuaaagugaucauaaggauagucugucuggugauggacuagcacuucuaugagcauuuuag

SEQ ID NO: 2252065 - RNA, 82 nt, Homo sapiens
ggauagauuguaagcauuugcgaguaguguugauauauuuuaauuugugagucaccaguacuccaaauugaggcggucaucc

SEQ ID NO: 2252066 - RNA, 83 nt, Homo sapiens
cagcagcugugccuguccugcagagucagaaugaugcgauaacgucauggugggcuggagagaccagcaauaccagcaugcug

SEQ ID NO: 2252067 - RNA, 91 nt, Homo sapiens
gcucuuccaggauacugggcuccucucacaauauucuuucucaugaucgucgugaggaguauguucuguagacccuccagugugagugagc

SEQ ID NO: 2252068 - RNA, 61 nt, Homo sapiens
gggugcucaucagcauugaccacacagguucugcuuaugugacuaguggugaaugacgccc

SEQ ID NO: 2252069 - RNA, 102 nt, Homo sapiens
acuugagcaagaaaaucaauauuuuugcauuucagcuauuuauuugcaaaacaguauagugaaaugaaucuggaaauauuguaagacuaaugcaaauuaagu

SEQ ID NO: 2252070 - RNA, 81 nt, Homo sapiens
ucaggaggacaauauggagacugaucccucuuuccucuccucugaggaggucgaggaagcucucagcucucuuuccccuga

SEQ ID NO: 2252071 - RNA, 70 nt, Homo sapiens
cuucaaaacuugaaaggacaggcugacucucauuuaaaaggcagaugcagcuggugauuuuaaguugaag

SEQ ID NO: 2252072 - RNA, 92 nt, Homo sapiens
aaagggaaguucuuauuuucuguaacuauuucuauagcugcugcuuuucugcuguugugauuauuuauagacagucaaaagagucucucuuu

SEQ ID NO: 2252073 - RNA, 60 nt, Homo sapiens
ugacagugcggguacaucauaggacacuggaggaaaguccuuugaauguaaagcauguca

SEQ ID NO: 2252074 - RNA, 58 nt, Homo sapiens
ucaguuuucucaucugugcaauggggacaucuuuccaaagcgcuguuaagaagacuga

SEQ ID NO: 2252075 - RNA, 90 nt, Homo sapiens
ugugaaagggacaugagauuugggaggggccaggagcaaaaugauauguuugggcuuuguguccccacccaaaucucaucuugaauugua

SEQ ID NO: 2252076 - RNA, 59 nt, Homo sapiens
aacccauugucauccuugcagugauugugagaaaaacauccugcaugagacaguugguu

SEQ ID NO: 2252077 - RNA, 69 nt, Homo sapiens
caggagucagcugugguuuaguagaaagaagauugaacuucuaguucaaagaccugguuuugaauccug

SEQ ID NO: 2252078 - RNA, 61 nt, Homo sapiens
auuaauagugcugugauaaacauauauguugugcaugugugucuuuaugguacuuuuuaau

SEQ ID NO: 2252079 - RNA, 66 nt, Homo sapiens
aucaccaaccaguagcugaguucaaaaacuacauauuucuugggcaguccucuacugguaugugau

SEQ ID NO: 2252080 - RNA, 64 nt, Homo sapiens
guauauauagcuagugauuguguguauauauguacauaaacacacauagcuaguguguauauac

SEQ ID NO: 2252081 - RNA, 73 nt, Homo sapiens
guuuucacucuguccucucaagcaauaaacuaaaauaugucuuuuuauugcaauuggcagagugcuaugaaau

SEQ ID NO: 2252082 - RNA, 66 nt, Homo sapiens
uaugaugaaagauuuccugagcuagaaauauccuaugauuuucauagcaagagguguugaaucaua

SEQ ID NO: 2252083 - RNA, 130 nt, Homo sapiens
ucaagagaguuuaugaaaggaaugagugaccuuuauguuaucaaaaagcuaaggaaguaucuguacaugcuuaccuuccuugaaugauguaauaugggucugucaggguaauuauuuaaacucuuucuga

SEQ ID NO: 2252084 - RNA, 59 nt, Homo sapiens
ugcuuuuucugaugagguaacauuuggauagaggucuaaaugcauugagggaaaaggca

SEQ ID NO: 2252085 - RNA, 86 nt, Homo sapiens
gguauuuuuuguugacuuagacauucaguuggaaggcuugaauuucugaguuccaacuucccugucuagguuuucuacauuauacc

SEQ ID NO: 2252086 - RNA, 67 nt, Homo sapiens
gucuuguugaucaauagaauacaacagaaaaggugguaugccauucugagguuuuguuaucaaagac

SEQ ID NO: 2252087 - RNA, 74 nt, Homo sapiens
ccuauugcauccauucuagacucaucuaaaccacccauugcuggucaagagaggucuaaaaugguugugguagg

SEQ ID NO: 2252088 - RNA, 58 nt, Homo sapiens
uccauuuuaagagugccauuucacaaaguccauggaagagguaugacuaugaagugga

SEQ ID NO: 2252089 - RNA, 68 nt, Homo sapiens
uacagcaaauguaugugguauacagaacaaugcuguauagcccuuuucuaacuauguguauuucugua

SEQ ID NO: 2252090 - RNA, 69 nt, Homo sapiens
agauaucauguuauagaugcuucuuuaagagcuaucagcucucuaacucugccuagugacaugguaucu

SEQ ID NO: 2252091 - RNA, 83 nt, Homo sapiens
uuuuauaaaaacaugaaaucacaauaaucccacuauauaccagcauaaccggguucagcuagaauuucauguuuuuggugaga

SEQ ID NO: 2252092 - RNA, 112 nt, Homo sapiens
ucuuggucgaaggcgaguuuccuggcaaagugugacgugggggucauuuguacuccuaacaugucuagacccucaugccauuuuuugaaagagcucgcagaagacgccagga

SEQ ID NO: 2252093 - RNA, 110 nt, Homo sapiens
gacuugacuuuugcuagauucauucguuccaguggauauuuacuagcaccugcugugugccaggcacugggcuagaugcuagagauaucauguugagcaagagacaaguu

SEQ ID NO: 2252094 - RNA, 57 nt, Homo sapiens
uugccagccugcaaauaacuggccucccagucaguuuguauuucagguugcaugcag

SEQ ID NO: 2252095 - RNA, 57 nt, Homo sapiens
gauagggcagucagugcuagaugaugacccauuauaauuagucuccucugcccuguc

SEQ ID NO: 2252096 - RNA, 56 nt, Homo sapiens
gaggcuuuucucugugccucacguaucuggucuuugagguagggauuaaagaccuc

SEQ ID NO: 2252097 - RNA, 58 nt, Homo sapiens
cacaggagguggagguuguagugagccaagauggugcuacugcacuccaaccuuugug

SEQ ID NO: 2252098 - RNA, 82 nt, Homo sapiens
ggccggcgcuuaccucugcuacaggguauguuuccacugacagacgcgcuggcgagaugcucgugugcagagagcacuggcc

SEQ ID NO: 2252099 - RNA, 58 nt, Homo sapiens
gcaggaguaaauuugcugaacucaaggcacugccuagagaaguaaauauuaucucugu

SEQ ID NO: 2252100 - RNA, 64 nt, Homo sapiens
uuguuuauccauuaaccagcgacuggucauuuguuugcuuccaguuuuuggcaaugaugaauaa

SEQ ID NO: 2252101 - RNA, 75 nt, Homo sapiens
guuccucaguacuuuguuauaacccacagguuuccgaagucaaagccugugggauuagaaaguauaagaaugaac

SEQ ID NO: 2252102 - RNA, 88 nt, Homo sapiens
aacagaacuugaaauuccaggaugcucacggucuacaguguaaaaugcugcacuuuaaggcauccccugagagcgauuucuuucuguu

SEQ ID NO: 2252103 - RNA, 129 nt, Homo sapiens
agccuccccagcccaucagucacgcugccaaggacacaggaaagaauaagaagucauagcuauugguucuuauggcuucuuauucuuucccguguccucggcagcguggcugaugggcugggggaggcu

SEQ ID NO: 2252104 - RNA, 71 nt, Homo sapiens
gcagcugcuguaccagaugugguuacauugcuugagcaaaauaacacaucuucugguaccugguaugcugc

SEQ ID NO: 2252105 - RNA, 82 nt, Homo sapiens
acucuuauaaaacuaugcuuauuaaaacaguguguuauuggcaacaaauggauaaacugacuuuuaaaagcaacuggagagu

SEQ ID NO: 2252106 - RNA, 74 nt, Homo sapiens
aaggaacacuucuacacugcuggugggaauguaaacuaauacaaucacuauugacaacaguguggagauuccuu

SEQ ID NO: 2252107 - RNA, 64 nt, Homo sapiens
ugguguauuuagaccuuauauacauuaaauguaauuggugauauguuaggaucuaagucugcca

SEQ ID NO: 2252108 - RNA, 130 nt, Homo sapiens
cuuaggagugacuuggcaaugcgggcccuuuuuuguuccauaugaacuuuaaaauaguuuuucccaauucugugaagaaagucauugguagcuugaugggguuggcauugaaucuauaaauuaccuuggg

SEQ ID NO: 2252109 - RNA, 75 nt, Homo sapiens
uucaguuuugguccuuucuagguauccacaucuuacccaggguugggggaaugccuagagagaaccauaacugaa

SEQ ID NO: 2252110 - RNA, 78 nt, Homo sapiens
uacacagugccuugcuguugguauaugcaccguuaguccauaauugugucaaauggcaauuagcauuggcuuuuugua

SEQ ID NO: 2252111 - RNA, 86 nt, Homo sapiens
gcuauuuucaaauaucccaauguaauaucacaaagguuuaaucaagucauaucugugugaugaaaaacauggguuugaaaaauggu

SEQ ID NO: 2252112 - RNA, 71 nt, Homo sapiens
gguaccuuaaauuuuuuaaauauuauccauuauuagaguagcugguagguuuauaaagaauuuagugugcu

SEQ ID NO: 2252113 - RNA, 113 nt, Homo sapiens
gugauauauauuuuuuuauuuuugaaagaugaacuggauuggaagauuuaucuuuguugugucuauuuugcaauugaggaaucauuuauuuuuagagaggugaauaaauucac

SEQ ID NO: 2252114 - RNA, 70 nt, Homo sapiens
agaaugcuuuuacacuguuggugggaauucaguuagcugaaccauuauggaagacagugugguaauuucu

SEQ ID NO: 2252115 - RNA, 57 nt, Homo sapiens
agccgugauugcaccacugaacaccagacgcagugucauguacuuguagucccggcu

SEQ ID NO: 2252116 - RNA, 61 nt, Homo sapiens
agacuuacagagaacaucuguccaggggcgcucugcacuguguggaugacugucugggucu

SEQ ID NO: 2252117 - RNA, 95 nt, Homo sapiens
ccgugaaauuccuguugcuuucaccccauguaguccaugaggaccgauagggccuucaaggacuacauggggugaaagcaacaggaauuucaugg

SEQ ID NO: 2252118 - RNA, 78 nt, Homo sapiens
gggcucuugaguucuaguucagaugcacacuguagucuaucccuggaccacaaugcauuugagccucaagaaaugccu

SEQ ID NO: 2252119 - RNA, 79 nt, Homo sapiens
uuuuacuggagaguaauuagacugaaagaaauacugcaugucuauuucuuugagacauaaauugccugcuuuaguagaa

SEQ ID NO: 2252120 - RNA, 56 nt, Homo sapiens
ugagcaagaaauagaaacagauuuaaggaaaucuagguguuggcuguucuagcuca

SEQ ID NO: 2252121 - RNA, 69 nt, Homo sapiens
ugacauggaagauguucaugauauacugcuuaagugaaaaaagcugguuucugaacauuaucuauguua

SEQ ID NO: 2252122 - RNA, 60 nt, Homo sapiens
cuggaaagcaaguccauugcuccaaaagguacauuuuagagcaauagacuugcucuccag

SEQ ID NO: 2252123 - RNA, 95 nt, Homo sapiens
gacagaugaugucaucaucuacguggcagaaaagagaagcaauggaaaagcuauuauuuuauuuuauuuugcuucagagauggugucacucuguu

SEQ ID NO: 2252124 - RNA, 69 nt, Homo sapiens
gauaguuacauauagauguauguguagauauguggguuauuagacacacauacauuuaucugcucuguc

SEQ ID NO: 2252125 - RNA, 64 nt, Homo sapiens
ggacucugcugguuuuguucacugcuguauccccggagcccagaacagugcuuaguagauguuc

SEQ ID NO: 2252126 - RNA, 58 nt, Homo sapiens
auugcaacauguauucuggugaucucugaucagggaucuuuuaugucacuguuguaau

SEQ ID NO: 2252127 - RNA, 58 nt, Homo sapiens
ucccagaacugaaaguuuaauuuaaaaaaaccugggaguuauaacuuuuguucugggg

SEQ ID NO: 2252128 - RNA, 84 nt, Homo sapiens
gagguuugggguaugauuaaacucaucacccagguaguaaggauaguaccugauagguaguuuuucaacucuuaccccuuccuu

SEQ ID NO: 2252129 - RNA, 57 nt, Homo sapiens
ccccacagguccucaggugaaagucacaaaguugcuccucugccaggaccugugggg

SEQ ID NO: 2252130 - RNA, 59 nt, Homo sapiens
auaguuuaauauucuguugagagcuuuuucagcuauuuucaucaggaauauugaccugu

SEQ ID NO: 2252131 - RNA, 56 nt, Homo sapiens
gaugagcuaguguaggguacugaucuaauuuguuaggcuuaagucaccugcucauc

SEQ ID NO: 2252132 - RNA, 116 nt, Homo sapiens
cccagcaccccccgcccagcuccccuaaugcacuuuccuccaaggcuggugaacuagacagaccggccaugggaaggaagaguguguaaugaccguggcaggggagggcugcuggg

SEQ ID NO: 2252133 - RNA, 66 nt, Homo sapiens
aucaaaucuccagaaccugucugugaauauuaccuuauuugcaaaauggguguuugcagaugugau

SEQ ID NO: 2252134 - RNA, 71 nt, Homo sapiens
cugcuugggaaagcugcagaaauucucaggacuuggaggcuugaaaugcucagggguuuuccagaaagcag

SEQ ID NO: 2252135 - RNA, 110 nt, Homo sapiens
gucagguaaguuaauaaauauuuauugagaguuuacauuguucaagcaauugugcuuuggacacuggagauucgucaguaauaggcacacauggaauuuaauaaucugac

SEQ ID NO: 2252136 - RNA, 67 nt, Homo sapiens
agaauuuuucagggccucagaguaggguggugugggcuacccuggauucguggccuugaauuguuuu

SEQ ID NO: 2252137 - RNA, 56 nt, Homo sapiens
uguggcuuuauuuagaagcagggucuuugcagauguuaagucaagaugaggucaua

SEQ ID NO: 2252138 - RNA, 115 nt, Homo sapiens
gaccucuaguccuuagaaccugaauucucauucugguuucacaaaagaacaaacuauucauuugugcaaacuaggauugcgaguuucucagagccagguaagguacugucagguc

SEQ ID NO: 2252139 - RNA, 62 nt, Homo sapiens
uccucaaaagaaagagaauuccugaugugaauaucauauuggcaauagcuuucuuacuaggg

SEQ ID NO: 2252140 - RNA, 76 nt, Homo sapiens
cugacccagcucaguuauagcauuaguggcagcaggguugcuugugccacuccagcucuagcuuuagguggcucag

SEQ ID NO: 2252141 - RNA, 69 nt, Homo sapiens
aagugcuggacauguguauuaccucgauugugaugauaguaucacaaauguuugcaugugucuaaacuu

SEQ ID NO: 2252142 - RNA, 72 nt, Homo sapiens
cccaacggacugagcgaugggaggaagugauaagugcagcugucucuucagcccauggcuucuuccucuggg

SEQ ID NO: 2252143 - RNA, 62 nt, Homo sapiens
uagggcauuuagaggcuauuaaguuaaacuaagcuuguuagaaugggcucugaugcaaucug

SEQ ID NO: 2252144 - RNA, 64 nt, Homo sapiens
auuaugaauagugccgcaauaaacauaugugugugugugucuuuguagcagcauaauuuauaau

SEQ ID NO: 2252145 - RNA, 70 nt, Homo sapiens
gugcucuaacccugaggggcuuggggaccaggccuauggcuuuguucucuggccucucaagguuaagcac

SEQ ID NO: 2252146 - RNA, 106 nt, Homo sapiens
guuuccucauuuguugagugagauaucuagacuagggaaaucuuaaagcuaacagccuucaguucccguguuuuaucuuccaacaucagcaacaaaaacaggaagc

SEQ ID NO: 2252147 - RNA, 130 nt, Homo sapiens
aggaucaucuucacuagcugucucagcauugccuuggaggucauugaugugcaacugcuggaacagucauaaacauggcugugcauacaaugccccauuugucaugcucaguuuaucugaaggugguccu

SEQ ID NO: 2252148 - RNA, 79 nt, Homo sapiens
caugugcauccgugugaagagaccaccaaacaggcuuugugugagcaacauggcuguuuauuucacaugggugcaggug

SEQ ID NO: 2252149 - RNA, 80 nt, Homo sapiens
ccggcuggacuccagaguggagccuuugcgaggggccagucaugguucucucugaaaaauucauucacuggguccccugg

SEQ ID NO: 2252150 - RNA, 108 nt, Homo sapiens
gaucccuucccagugaguguagguagaacaugugaaugugaucggauagucacuucugugauuauaaugcauuauaugggacuccacucuaacacauuaggagggauu

SEQ ID NO: 2252151 - RNA, 66 nt, Homo sapiens
ucuauauaauagguugauugacauugccugcauaugguaggucaauguuaguauuuauuaaaugga

SEQ ID NO: 2252152 - RNA, 56 nt, Homo sapiens
uuggccagugucuuuuuuuccugucauauauuuaggaagauugagauaaugacuaa

SEQ ID NO: 2252153 - RNA, 89 nt, Homo sapiens
gguucaguggcugcaaauggaucugauggagagcguguggcuuugggaggagugugccgccuuccacagugagcagcgaggcugggacc

SEQ ID NO: 2252154 - RNA, 75 nt, Homo sapiens
guuuguccaaaucagagguaccaaaagcuauuaugacuaucugcaguaaugugauuugggccucuuuuggaagac

SEQ ID NO: 2252155 - RNA, 55 nt, Homo sapiens
uugagacggagucuugcucuuuugcccaggcuggagugcaauggcucagucucag

SEQ ID NO: 2252156 - RNA, 66 nt, Homo sapiens
gccagguggacuaauaucaugugacugaaagcccccacccuaaaucacaugguagguuuuucuggc

SEQ ID NO: 2252157 - RNA, 66 nt, Homo sapiens
uuagcauaagggcaagcucuuuaguguccuucaaagcacauauguaaauagcugccuguguacuaa

SEQ ID NO: 2252158 - RNA, 60 nt, Homo sapiens
uagugguucuccgaggaugaucaguguaaaucuagcaucagacauggaggaggauuauua

SEQ ID NO: 2252159 - RNA, 76 nt, Homo sapiens
gccugggacugacugggaggcucugaccauuuacccaccacagguagguuguguucugagccucagguucacaggu

SEQ ID NO: 2252160 - RNA, 62 nt, Homo sapiens
uuucuggcaagauauccauugcuuuuauuuggucuucaaagcaucuaggauguuuccaggaa

SEQ ID NO: 2252161 - RNA, 76 nt, Homo sapiens
uagguuggugcaaaaguaauuaugguuuugcuauugaaaguaauggcaaaaucgcaauuacuuuugagccaaccua

SEQ ID NO: 2252162 - RNA, 80 nt, Homo sapiens
gagccacacgccugucgcacaucuugagagggagaugagagaacccucccauuucacugagacaugugcccagugugcuc

SEQ ID NO: 2252163 - RNA, 56 nt, Homo sapiens
auaaucccuuuguccagucucuuuucucuggaaaaguugcuaugaaaagggaauau

SEQ ID NO: 2252164 - RNA, 108 nt, Homo sapiens
ggaaaaucuuucuuuguccucaagauaauaauuaaaaauagucuaugcaagauuuauuuugaauagaagguuuuuuguucagauuaucauaggaaagagaauauuucc

SEQ ID NO: 2252165 - RNA, 69 nt, Homo sapiens
ccugaugauggucaggaugccaccuguaugugcaugcuggcguuacucuccaucagcuucugucucagg

SEQ ID NO: 2252166 - RNA, 60 nt, Homo sapiens
uuggagucaucucuguacuguaaagauuagauagaacucaucaggcucugaugacucuaa

SEQ ID NO: 2252167 - RNA, 91 nt, Homo sapiens
uguuacccauaauuuggaauucucacucagauuugaucaagucagguagaguuggucaaaucugaugugagaaagaccggaauaaauaaca

SEQ ID NO: 2252168 - RNA, 87 nt, Homo sapiens
guuugauacucacagagagcuugcccuuguauauuccaugucaauaaaccgaauauacaaagggcaaccucgcuuuaaguaccaaac

SEQ ID NO: 2252169 - RNA, 64 nt, Homo sapiens
ucauguugaaguagugcuacagauguuuaugauuauccuacucagacugagcacugcuuuauga

SEQ ID NO: 2252170 - RNA, 83 nt, Homo sapiens
uguaagagccuuuucuuuaaucacaaaacgaagaauuuucucuagcuuuucuacauauugugguugaugaagacugucuugca

SEQ ID NO: 2252171 - RNA, 76 nt, Homo sapiens
ucgcuugaacacaggaggcagagguugcagugagcugagaucucaccacugcacuccagccuuagugacagaguga

SEQ ID NO: 2252172 - RNA, 116 nt, Homo sapiens
aacaaugcuuuauuuauuuugauuucacaguguucucccccagaaaagauuuauuuauuuuuaucuugguuuguggaaaggagacuugagguuguuaaagagaaaccgucauuguu

SEQ ID NO: 2252173 - RNA, 84 nt, Homo sapiens
gcaaaccaguuuaaagaauguuaugcuuucccaaucaauaaaaaaguggucagaaagacaggcauucagcuagcaaauguuugc

SEQ ID NO: 2252174 - RNA, 130 nt, Homo sapiens
ggaggaaaauagcaggguacaugucuguuuaguuugauaagaaaugccaguuuggaaaaaggcuuagcuuauuuaucuuuagccauuggucuuuucuuacauaacucauuauggcucuaaauuuucccuc

SEQ ID NO: 2252175 - RNA, 105 nt, Homo sapiens
gggggcagaaggaaagaagacuaaugugcuuguauuuaaaucauguguucuuuuucagaaucagauucaaauaaaggcaugcugcuacaacucuccacuccccuc

SEQ ID NO: 2252176 - RNA, 116 nt, Homo sapiens
uuggaagaagauucuggugaugaugugugggcaguccaguuuccauuccugagaagugucgacuuugaagagacagguucccacaaaauugccuagggaccaaguucucuuuccaa

SEQ ID NO: 2252177 - RNA, 57 nt, Homo sapiens
uacucuuaaugugcgggaauguauuuccuuaaaauucuucccucagccuugagggua

SEQ ID NO: 2252178 - RNA, 122 nt, Homo sapiens
auggaaccuggagaggguaugguuuugguuguuaucaaaauagugcaggggucuucguuugaugaaugagagaugaacuauucuugaaauaaucauaccccagucccuacccaaaaaucuau

SEQ ID NO: 2252179 - RNA, 55 nt, Homo sapiens
guuucaggcaccauggucauugauaacaucuuaucaggagacaggguuuugagau

SEQ ID NO: 2252180 - RNA, 109 nt, Homo sapiens
acagcaugguggcauuuuccccaagaaguuuggccauggagcacuuuucuagaacaugcuaggagacuaaagcucuguggcacacgccuggguuggucugucaugcugu

SEQ ID NO: 2252181 - RNA, 61 nt, Homo sapiens
auguuauugcucucgaagacucuccaaugagaaaaaacguggagaggggagacagugauau

SEQ ID NO: 2252182 - RNA, 55 nt, Homo sapiens
auguaugucuaaaacggggaggcaugaauaauccaccccguguuuagcauaucau

SEQ ID NO: 2252183 - RNA, 68 nt, Homo sapiens
guagaaagagaagcagugaggugcugucaguugugggaguagcacagggaauugguucucuagucugc

SEQ ID NO: 2252184 - RNA, 68 nt, Homo sapiens
uaauaaguacucuggaguaggccuaauuuacagaagcagucuugguuaucuacaccagagcacuguua

SEQ ID NO: 2252185 - RNA, 93 nt, Homo sapiens
ugauucaauaaauuuaacaauuuugucauuguucaugccaaagaaucauuuuaauaggcauuuuaggugacagugguuaaaauuuguuaauua

SEQ ID NO: 2252186 - RNA, 106 nt, Homo sapiens
gaggcggaggcacaagaauugcuugaacccaggaggcggagguugcagugagcugaaagcacaccacugcacucuagccccugcgacaagacugaaacucugucuc

SEQ ID NO: 2252187 - RNA, 57 nt, Homo sapiens
ucugcuaagguguagacuggucacaagauaggcaacuucuccaauuacuccugcaga

SEQ ID NO: 2252188 - RNA, 73 nt, Homo sapiens
acagaccuggcgcagugugcagaggagugaaggcacccugcuuuggucuccuuuguacccugggcagaucugu

SEQ ID NO: 2252189 - RNA, 69 nt, Homo sapiens
ggggaggaugaucuugugugugccaggcuggugcccuccaacuggcauguuuuaaggcuuaaccacccc

SEQ ID NO: 2252190 - RNA, 85 nt, Homo sapiens
uucuccuuauauguguaucuaaaguagucaaacucuuagaaauuaaaaauagaauggugguugccagaugcuggugugaggggga

SEQ ID NO: 2252191 - RNA, 56 nt, Homo sapiens
ggaucacugugaaccgugucaggggcagauugcuagcacaggugucgaaguggucu

SEQ ID NO: 2252192 - RNA, 66 nt, Homo sapiens
gaggguaaauauggucccuguuaccucauuaugguuaggggcguaacaggaccauggaaggcuuuc

SEQ ID NO: 2252193 - RNA, 61 nt, Homo sapiens
guggugagaaaagaugucuuuguuccauaucuuugcaaacaagcuucuaguuucucaccau

SEQ ID NO: 2252194 - RNA, 70 nt, Homo sapiens
ggugaccucuacacuguugacauuuuguaguguggaacuguuuaugcauuguaagaugucuagcagcacc

SEQ ID NO: 2252195 - RNA, 68 nt, Homo sapiens
agcuaucuaaauucaugucaccucuagguaagguuaaauccuucuccugugaucuggauuuuuaggcu

SEQ ID NO: 2252196 - RNA, 88 nt, Homo sapiens
uccuuucacuggaauuuucuugguuaggggaaauaggcaguguaaucauuuuuccugucugaccucaaccagggguaaacuaaaagga

SEQ ID NO: 2252197 - RNA, 58 nt, Homo sapiens
guucaguuugcugaugcguugagaauuuuuacaucaauguccaucagaaaaacugagc

SEQ ID NO: 2252198 - RNA, 81 nt, Homo sapiens
gcuauuuuguuuuauacuguuuuacaucauugccuuuccccucuaauagagugugaucucuaaaacaggaaagacagcagc

SEQ ID NO: 2252199 - RNA, 63 nt, Homo sapiens
cuguccugcaaauguguuuuaaaccaaagaaaucaucuuuggcaugggcuauuugcuuuauag

SEQ ID NO: 2252200 - RNA, 89 nt, Homo sapiens
uugcccuauugcauggcuuguauaagauucucaucuguccauccaaaucacagauuugagggcuucuaccagaacaugaagcugggcaa

SEQ ID NO: 2252201 - RNA, 62 nt, Homo sapiens
uuaucagcagagucauacuucaaaaauuauaaaguauuuuuguuaggugguuuguugacuga

SEQ ID NO: 2252202 - RNA, 61 nt, Homo sapiens
uucaaaguguugguuuugggcugggcgcgguugcucaugccuguaaucccagcacuuuggg

SEQ ID NO: 2252203 - RNA, 59 nt, Homo sapiens
uguccaggcagaaguucgcugcagggguggagcccucauggagaacuucugcuagggca

SEQ ID NO: 2252204 - RNA, 55 nt, Homo sapiens
cugguaagaaggucuaagucaauccauuaguugauucacagaauaguuuuaccag

SEQ ID NO: 2252205 - RNA, 89 nt, Homo sapiens
uaacaggugugaaguaauguuuuauucuauuuuguauuugaauuucucuggugauuaaugauauugaacaucuuuucauauaccuguug

SEQ ID NO: 2252206 - RNA, 55 nt, Homo sapiens
augagauaggaacaaacuuacaggaugcuuaucuggaccuuguguucuaucucau

SEQ ID NO: 2252207 - RNA, 55 nt, Homo sapiens
gacaguaaagucaggauucacauccaggugaucugacuccagagacugugcuguc

SEQ ID NO: 2252208 - RNA, 110 nt, Homo sapiens
cagaaagacacugcuuggaggcagggacuccugagacucacaggcuccccagcacggccacuggggacacaggccaguccaggggccccagcccuuugguucccuuucug

SEQ ID NO: 2252209 - RNA, 99 nt, Homo sapiens
ugucucaauugucugguaugcaagugauaugacauauuuguguuaauaaauuugugucuuauaugcauuugugugcaggcagucacucaaacugggaca

SEQ ID NO: 2252210 - RNA, 83 nt, Homo sapiens
augcauguguuaguuuggaagacauucugucugcuagaaguucugcuuauaguuguauaaugucuuucauaacugauaagcau

SEQ ID NO: 2252211 - RNA, 59 nt, Homo sapiens
uggggcuucagcagcuguaaacaucuaccccuagaugcugccaugggguuguagcccca

SEQ ID NO: 2252212 - RNA, 76 nt, Homo sapiens
ucuggaugagggccagaugcauuuguuauuugucuauaaaacgagucaagagcugcuccauuugucccucuuuaga

SEQ ID NO: 2252213 - RNA, 92 nt, Homo sapiens
aauuaaugguagagcuggaguuaggacacaugucucacaguuccuaguucguuuugcuuugaugugcuugaaauucaguuuugacauuaauu

SEQ ID NO: 2252214 - RNA, 64 nt, Homo sapiens
gcuuuguuaggacaggucuagaauacccuuuaguuuaggguuaauuuugcacuccuacuaaggu

SEQ ID NO: 2252215 - RNA, 66 nt, Homo sapiens
uuucaucacagacauuuuuaagugggacuagcuuuuccucucuccaugagguguacuguggugaaa

SEQ ID NO: 2252216 - RNA, 99 nt, Homo sapiens
gaggcaggagaaucauuugaacccaggaggcagaaguugcagugagccaagaucacgccauugcacuccagccugggugacagaaugagacucugucuc

SEQ ID NO: 2252217 - RNA, 96 nt, Homo sapiens
auguuaaguaugugagguaaugaauauguuaauuagcaucauuuagucauuccacgauguaugcauaguucaacauauaucacauaugauaaauau

SEQ ID NO: 2252218 - RNA, 59 nt, Homo sapiens
auagauauagacuagaagcaauggcuuucacuaaaauggccucuagacacugugucuau

SEQ ID NO: 2252219 - RNA, 114 nt, Homo sapiens
uuuguaugacucuucuguggucugugcauuuucuuuuagacuugguuaaucuuugggcauugguuuaugagaagugcaugaaagagcauccaggagaacacuucgucaaauaaa

SEQ ID NO: 2252220 - RNA, 61 nt, Homo sapiens
agggcagguucucaagcaauccuuagccuguggcuaggauaguccuccugagaccugccuu

SEQ ID NO: 2252221 - RNA, 74 nt, Homo sapiens
acguaugggaaggacauucugggcucaggaacauccaguacaaaggcccugaggugggaguuuuucucauaugu

SEQ ID NO: 2252222 - RNA, 56 nt, Homo sapiens
cugaaaucagccaguuaguuucuguugcgugcaacuaagaaugcuggcugauucag

SEQ ID NO: 2252223 - RNA, 72 nt, Homo sapiens
uaauaucauugaaucauuggggcaaagugauuuacuguuacugcuuaagugauucaacauuccugaucauua

SEQ ID NO: 2252224 - RNA, 65 nt, Homo sapiens
ucagcauugucugggauuguuuuaugagaaaugcagaaucucagaccuuaucucagaccugcuga

SEQ ID NO: 2252225 - RNA, 61 nt, Homo sapiens
cacaguguucauagccaucaggaacuuggaaaacaaacuuuggugaaugcgagcaacugug

SEQ ID NO: 2252226 - RNA, 85 nt, Homo sapiens
uucaaggccaguuugucucacuggaguuuaguaauugaaccauauggcuuauagauuauugaaucuaguguuacaagucucugaa

SEQ ID NO: 2252227 - RNA, 71 nt, Homo sapiens
auuucugugucuucaguucuuagcucauaguagguauuuaauacauauuuguaggacuaaagacuagaagu

SEQ ID NO: 2252228 - RNA, 98 nt, Homo sapiens
gaggcaggagaaucgcuugaaccccggaggcggagguugcagugagcugaauuucaccauugcacuccagccugggcgacagagugagaauccgucuc

SEQ ID NO: 2252229 - RNA, 56 nt, Homo sapiens
acaaggggagacgcugguaggcagccucaaaaauggugcccagugaucccuuuugu

SEQ ID NO: 2252230 - RNA, 108 nt, Homo sapiens
gcugagauuacaggcgugagccacagugccugcugucuaauauauucuuuaugcauuuaaaaauaugucaagaggcuggacacggaggcucaggucuguaaucccagc

SEQ ID NO: 2252231 - RNA, 55 nt, Homo sapiens
ugucucucuuucugucguuacuuuaaagagguucugauaugguagaagagagaca

SEQ ID NO: 2252232 - RNA, 84 nt, Homo sapiens
ucucaugcagucauucuccaaaagggagcacuuucuguuugaaagaaaacaaagugccuccuuuuagaguguuacuguuugaga

SEQ ID NO: 2252233 - RNA, 83 nt, Homo sapiens
uucuaucauagucaguggaguaaauguaauuucuaaaacaagcugaguuuauguauacuuaacuggaaaaaauugaaauggaa

SEQ ID NO: 2252234 - RNA, 62 nt, Homo sapiens
uuggauccaucuggaaaugugggacaaccaggguggggcuuccaagucauagauggauucaa

SEQ ID NO: 2252235 - RNA, 103 nt, Homo sapiens
ccucaaccauggguuuauaugauugguagacccugcagauccauucccaaugguguaucuucauacuaaucaugaaauccaucuaauagccauacaagugagg

SEQ ID NO: 2252236 - RNA, 72 nt, Homo sapiens
ucugacaaugaacaaucuauaguuauauccuggauaagccuagucaaacucaaagauugguuagaugucaga

SEQ ID NO: 2252237 - RNA, 68 nt, Homo sapiens
cagcaaaucucaucacaguacuaaucgucauacgaggucucguagacgaaggacugaugaagaugcug

SEQ ID NO: 2252238 - RNA, 124 nt, Homo sapiens
guuuauaugcugauaucaacucugcccugguugauuuuuauucuaggguauuugcagaguucccacuuucaaaugcacguagagaaaauaauccccaucaggacaucuggcauuguuuuuaaac

SEQ ID NO: 2252239 - RNA, 62 nt, Homo sapiens
cuuuuggugguucugaugcaggcuaaacuuagagaaccccuaguauaaagagaagccaggag

SEQ ID NO: 2252240 - RNA, 75 nt, Homo sapiens
uuuuaagcaugauugggguugggcacaauugacuucaaacucugaaucugcugccuaaugucauaugaaauaaag

SEQ ID NO: 2252241 - RNA, 125 nt, Homo sapiens
uucuuguccuaaguccuguggucuauugaauuauuuauggcuauucuucuuuugucagucuucaaagagauagaaaaauaugugaaugguuauggagcuaguaguuaguggagcuagaaccagaa

SEQ ID NO: 2252242 - RNA, 55 nt, Homo sapiens
cuggagugagaacuucaaugauggccauuaggccaauuggauggucuuuuuccgg

SEQ ID NO: 2252243 - RNA, 66 nt, Homo sapiens
cuaugagucugcagaucuauuaaggggcccaccaaguacaccucuauggaauuccagacuauauag

SEQ ID NO: 2252244 - RNA, 76 nt, Homo sapiens
ucacuugaacccgggaggcagagguugcagugagccaagaucaugccauugcaccccagccugggugacagaguga

SEQ ID NO: 2252245 - RNA, 64 nt, Homo sapiens
gcagauuaaguggauuuaaaugucugguccauagcaaugucagcaccuuuccuccacuaucugc

SEQ ID NO: 2252246 - RNA, 67 nt, Homo sapiens
cagcauguuauuuccuuuacauguccuaugaacaagaauuuucauuuuguaaaggagauugcagcug

SEQ ID NO: 2252247 - RNA, 69 nt, Homo sapiens
auuauuggucuaugcaagauuucuaugucucccugauucaagcuugggaguuuguauguuuccaguaau

SEQ ID NO: 2252248 - RNA, 82 nt, Homo sapiens
aaugugucuuaugaaaauugccaaacaacugucccuggggauucugcuuugauuggcauuuuuagucaugggaauguauauu

SEQ ID NO: 2252249 - RNA, 59 nt, Homo sapiens
gcaggagcuuccagaugggcaucagggauacuccagucuugucuauggggguucucugc

SEQ ID NO: 2252250 - RNA, 64 nt, Homo sapiens
agaauuuuuauagcuauauugucgaguguguagaaagcuuuugauaacagcauaugaagauucu

SEQ ID NO: 2252251 - RNA, 64 nt, Homo sapiens
uuauuuuuauggcauuuggugugacuacccucccauccuggagacaucagaguugugaagguag

SEQ ID NO: 2252252 - RNA, 96 nt, Homo sapiens
gcacacacagauagugcaguuugagguucacagaugcuugacccauuucuacucacuaggauggacucaucuguucauguugcauaacuguugugc

SEQ ID NO: 2252253 - RNA, 59 nt, Homo sapiens
gagcugcaauguuuaguauaauauauguacggcauauguugcuggaguaguugcagcuu

SEQ ID NO: 2252254 - RNA, 74 nt, Homo sapiens
ugggcuugauauucagucagcuaaguaaauggauggagccaccuucaguugcaucaguugaccaguuaagucua

SEQ ID NO: 2252255 - RNA, 63 nt, Homo sapiens
ugagauuugggaggggccaggagcagaauaaugugauuugguuguguccccacccaaauuuca

SEQ ID NO: 2252256 - RNA, 65 nt, Homo sapiens
auaguugaggacauuguuccuaauauaaacccuaagaggggccgggcacagugucuuacaccugu

SEQ ID NO: 2252257 - RNA, 85 nt, Homo sapiens
ccagcaugggagaaagaugagguagaagacucagcaaguuggcuuuucccaccuucuuccaucugcuuuauccuagccgagcugg

SEQ ID NO: 2252258 - RNA, 130 nt, Homo sapiens
auguuagcaacuagcucaauggauucccagauguuagcaucuggcacuauggacucucaaauguuagcuucuggcaccauggaugcucagauguuagcgucugguaccauggaugcccagauguuagcgu

SEQ ID NO: 2252259 - RNA, 55 nt, Homo sapiens
cuggugucuggugauggagacaggaggcugggucugucuuggagccagacgccag

SEQ ID NO: 2252260 - RNA, 66 nt, Homo sapiens
guuuuauugaaacacagccacacucauuuguuuauguguugucuauggcuguuuucaugcuagaac

SEQ ID NO: 2252261 - RNA, 77 nt, Homo sapiens
uaucuagccuaugaagcuuguccagccuagaagauauuaagaugggcauuaauguacucauuucauaggguuaggug

SEQ ID NO: 2252262 - RNA, 115 nt, Homo sapiens
gaaagaaaugaagaaacagaugccugaagcauuugggaaaguaacuccacugcagcugaaauacuggauguugcaggguccauugucccaaguuaguauagguugcauugauuuc

SEQ ID NO: 2252263 - RNA, 62 nt, Homo sapiens
agcugccuggagucauuuccugcaggaauuccaugucuucccauugaaguguuucagcagcu

SEQ ID NO: 2252264 - RNA, 117 nt, Homo sapiens
uguucuuuuaagagggacucagcagucaggggagauggcaaugcgaugaugacugagugucuuagucuuuuuuguauugcuaugcaauaucugaggcuggguaauuuauaaagaaca

SEQ ID NO: 2252265 - RNA, 60 nt, Homo sapiens
gaucucaagagacuaagaaagggcaauaauaguuguugcaccugccuugcuuuagagauu

SEQ ID NO: 2252266 - RNA, 90 nt, Homo sapiens
caggcuuggggcagaguaaguguaaguuaauguuuaggugaguauguucauuuacugucaugaaaaguuguacuuuucucucuaagcuug

SEQ ID NO: 2252267 - RNA, 56 nt, Homo sapiens
uaauaguguuaaugcuagagcuaucaucauuauuaguaccagcaccagcacuauua

SEQ ID NO: 2252268 - RNA, 115 nt, Homo sapiens
agugccaggagaggaccggagcauaguuagugcuuauuaaauaguaucaugauaacaugacacauguaaaacacuuagcaauguucaauaaacucuggucccuuuccuccccacu

SEQ ID NO: 2252269 - RNA, 76 nt, Homo sapiens
ucuaaacaacagacaguguuuacagaacgugagcaaagacuaauucuuuguuauguuaaacuacugaaauuuuaga

SEQ ID NO: 2252270 - RNA, 60 nt, Homo sapiens
aguguggccuuacuuggacacagagggucuuugcaaaugucaucaagaugaggucacacu

SEQ ID NO: 2252271 - RNA, 59 nt, Homo sapiens
uuguucaucaggugacacauacuaagugccacuuagcacauguggucauccugggacga

SEQ ID NO: 2252272 - RNA, 95 nt, Homo sapiens
cagagaggaugagagacaugccuaggguugcacaguccauagcagggaagucaguguucaaacccaggucugucugaugcccauacccuugacug

SEQ ID NO: 2252273 - RNA, 94 nt, Homo sapiens
guuauuauucauggcuauccccuaaugacucaaauaucagcacccauaggggugaugauauuugagucauuagaaaauaguagugaauaauaac

SEQ ID NO: 2252274 - RNA, 129 nt, Homo sapiens
caagauggcagugagugagguacgaucaugccacugcacucuaaccuaggacacagagcaaguuccugggucucacucugugguucaggcuggagugccauggugcaauuacagcucacugcagccuug

SEQ ID NO: 2252275 - RNA, 77 nt, Homo sapiens
gcucuaagccuagaccagucauuacucaugcccugggacaauucaggcuguguggauaauauugggguuuaguuagc

SEQ ID NO: 2252276 - RNA, 75 nt, Homo sapiens
uucuugcuuguugggucaguuccuugacuccucuuaguuggggaggaucaggguaaugaucgaaaaugaagagaa

SEQ ID NO: 2252277 - RNA, 64 nt, Homo sapiens
cagggcuggauccagaggcuggagguccggcaaggaggaaccuaggcacugggguccagcccug

SEQ ID NO: 2252278 - RNA, 129 nt, Homo sapiens
uuguauuuucauccucuuaguagaguugcuuccagagauaaagauuuuaauuuugaugaaguccaaauuguuaauucauuaauuuaaauuuauuguguuuugguguugaaucuaagaauuauuugacag

SEQ ID NO: 2252279 - RNA, 97 nt, Homo sapiens
ggcacauucaguccauagcacauggcauccucucuuggggcacaguuuucaaugguuucccaagagaggaugccaugugcuacggacugaauguguu

SEQ ID NO: 2252280 - RNA, 69 nt, Homo sapiens
gcuacugugcaaaaaugaauauuguaauauuaaaagagaaacuaauuguucaguaucauugcacauagu

SEQ ID NO: 2252281 - RNA, 61 nt, Homo sapiens
uauaugcacucagguguaugugagcgcuccuguuugugccuguguguaccgaguguguaua

SEQ ID NO: 2252282 - RNA, 71 nt, Homo sapiens
cguuucccuggagagggugaccaggguaggcucugcagacaagcaaccuugaauagcccuuucucaagacg

SEQ ID NO: 2252283 - RNA, 66 nt, Homo sapiens
accacgccuggcuaauuuuuugaaucuuuaguagagacaggcuuucaccguguuggccaggcuggu

SEQ ID NO: 2252284 - RNA, 89 nt, Homo sapiens
uuauuagguuggugcaaaagugagugaggguuuuuuuugccauuaaaguaauggcaagaacuucacucacuuuugcaccaaccuaauag

SEQ ID NO: 2252285 - RNA, 82 nt, Homo sapiens
cucugugccuuucucaguucgguggcagugcuggcaccaccuucugcagggcgccucugagcucgagggaggguggacagag

SEQ ID NO: 2252286 - RNA, 75 nt, Homo sapiens
uuucaauaguacaggguguaguacaguuaaauuuauguaguuaugauuuaauacugcaucuuuacucuuuugaga

SEQ ID NO: 2252287 - RNA, 71 nt, Homo sapiens
ggcagaugcugcaaucucggcacuuugggaggccaaggcaggcggcugggagguggagguuguagcgagcc

SEQ ID NO: 2252288 - RNA, 83 nt, Homo sapiens
ggggcagugcuuaugcaucauucuggcauaaugaaaaugguuucucaucauugcuagaugaaguuugaguuuucuccugccuc

SEQ ID NO: 2252289 - RNA, 67 nt, Homo sapiens
uaagaggcaaguugcucaaaugcaaaaugaaugguuaguuuguucagugcaauuugaaauccuuuug

SEQ ID NO: 2252290 - RNA, 59 nt, Homo sapiens
uugcaccccuacuauuugccaauuacuaugcaauaaaagauaaauaggacugggugcag

SEQ ID NO: 2252291 - RNA, 76 nt, Homo sapiens
uaguuuacugagaaugaugauuuccaauuucauccaugucccuacaaaggacaugaacucaucauuuuuauggcug

SEQ ID NO: 2252292 - RNA, 116 nt, Homo sapiens
guauuuuuuuaaaaaguuuuauaguuuuacguguuacauuaugaguccaaaauccauuuuugaguuaauuuuuguaucaugugugacagggugugauuaauuuuuugucuauguau

SEQ ID NO: 2252293 - RNA, 64 nt, Homo sapiens
gacaauguuauaaaguaugagaccugaacaaaaauuucaggugcuuacuuaauagccauguguc

SEQ ID NO: 2252294 - RNA, 62 nt, Homo sapiens
gcaucuagcacagugucauucuagguacugaauagguaucuguuaacaucugugcagcaugc

SEQ ID NO: 2252295 - RNA, 79 nt, Homo sapiens
agaacacauuugcagagccccacacugggcuccaggcuccuagaagcagcgggagccugcgugggggcuuugcaguucu

SEQ ID NO: 2252296 - RNA, 63 nt, Homo sapiens
gggaaucuuguuggaaugcagauucugauucaguaagucugagacuguuucuaacaagcucuc

SEQ ID NO: 2252297 - RNA, 83 nt, Homo sapiens
gggacacgggcaucugggacuuugguauccauggggaguccuggaaucgauucaccauggcuaccaagggucaacuguauucu

SEQ ID NO: 2252298 - RNA, 62 nt, Homo sapiens
uggguuaagggaauguuguagcugguuugaucuacucaaaccacuaaaacuuucucuuucca

SEQ ID NO: 2252299 - RNA, 62 nt, Homo sapiens
ggaguuaugggugaggaggaggugcagcuccaaagccuucauuuccuggagcguauggcuuc

SEQ ID NO: 2252300 - RNA, 102 nt, Homo sapiens
cugauauuuuuagaccuuucuaguauagucuggaugcuaccaugauaauuaaagguaggcauguggcucuguucugaccaaugagauguaaagagaagucag

SEQ ID NO: 2252301 - RNA, 76 nt, Homo sapiens
gggcugcugcuuuuuuuucagagaugcccugcccagagggcaggaaucuugagaaggauucuggccacaguggccc

SEQ ID NO: 2252302 - RNA, 70 nt, Homo sapiens
ucucuuuaguugucuccucaaggguacuagucacucaguagaguaccauuugguugggcagccaaagaga

SEQ ID NO: 2252303 - RNA, 83 nt, Homo sapiens
gcucuucuucccuuggcugcaggcaucuggagauuuggggccccucuuuccaagaugcuggcagcuacagaggaagugggagu

SEQ ID NO: 2252304 - RNA, 90 nt, Homo sapiens
ucucaaaccguaacccucugaaaggaagcacuuucuuuucuuucagacaacagaaagugcuucuuuccucgagaaggucacagccugaga

SEQ ID NO: 2252305 - RNA, 69 nt, Homo sapiens
cuggaagggcaggccucaggccugaccuucaggaauggcuccuggaggacugcagaacugaggccccag

SEQ ID NO: 2252306 - RNA, 59 nt, Homo sapiens
gccucccggguuccagcgauucuccugccucagccuccuggguagcuggaauuacaggc

SEQ ID NO: 2252307 - RNA, 92 nt, Homo sapiens
agggccacgccuuacacaaggugacaugaaaaauguugagguguagcaguuuauucccuuagguuaaucaugaaccuuucuguuaggccccu

SEQ ID NO: 2252308 - RNA, 55 nt, Homo sapiens
guggcgaaugccaggugcagaccaugugaccacgcguggcacuggcguaucccac

SEQ ID NO: 2252309 - RNA, 73 nt, Homo sapiens
aucucuuguugggagugucucuggacugcagccugagcuagcuggcagacuuccaugagguccccugagaggu

SEQ ID NO: 2252310 - RNA, 57 nt, Homo sapiens
guccaagagcauggcaccagcguccggcaagggcuucgugcugugucaucuuguggc

SEQ ID NO: 2252311 - RNA, 61 nt, Homo sapiens
aaugcuguguuauuucaugaccacaucaucacuauuugaagucauguaaugacuuaguauu

SEQ ID NO: 2252312 - RNA, 67 nt, Homo sapiens
auguuuacaguauugcaaggacuaggaaaucccucauugauaccaguccugccagucuugucaauau

SEQ ID NO: 2252313 - RNA, 65 nt, Homo sapiens
gagguaagagggagucacacaaaauaguaagguuucauucuuauguagucauuccuuuuugcuuu

SEQ ID NO: 2252314 - RNA, 71 nt, Homo sapiens
gcaugaucuauaguauagcauauuaagcauuuguacuuccccagaugcauugguggcauauucauccgugu

SEQ ID NO: 2252315 - RNA, 98 nt, Homo sapiens
acucgaaauuaaacauggugcuugccuuucaagaggcuuucaggccaacaagguuuggacuucucaaggcaauaaaugcauugucuuuaaucaagagu

SEQ ID NO: 2252316 - RNA, 79 nt, Homo sapiens
agaugcuuuuucucuuucgaugaggcuauguccccaaaaacccaacauaagucaacaucaugaaguggaaaauacauuu

SEQ ID NO: 2252317 - RNA, 56 nt, Homo sapiens
uaacacagagcuccuaaucccuuggaauuuuccaguugauaggagcauuuuuguua

SEQ ID NO: 2252318 - RNA, 82 nt, Homo sapiens
gcugcucucacugagaauggguucuaagcacccugggcuuugccucacuugcuccaguuucagaaucccauguggaagcagc

SEQ ID NO: 2252319 - RNA, 72 nt, Homo sapiens
ugucccaugguacugccacagaagagucucagcucucuccaggauucaguucuaaggucagugccuaagaua

SEQ ID NO: 2252320 - RNA, 75 nt, Homo sapiens
cacgaugcaaaugcuucacaucucuggugauuugaauugaaucacacuugauguugagcaacacaccugcuugug

SEQ ID NO: 2252321 - RNA, 68 nt, Homo sapiens
uccugagagcagacccucuauaaaucacaggcaccuagaccccuguucucagggucugcguucaugga

SEQ ID NO: 2252322 - RNA, 105 nt, Homo sapiens
gcuagucaaauaucuccagaaguaagguagcugagugaagugguucauaaucuuuccaugggagccaaauccucggugcugugacucuuuuagauaaaugauagu

SEQ ID NO: 2252323 - RNA, 63 nt, Homo sapiens
uugauucguguauauucaaccuugcauccuagggaugaagcuaacuugauugugauggaucaa

SEQ ID NO: 2252324 - RNA, 82 nt, Homo sapiens
uauuggguucgugcaagagugauugcaguuuuuguaaugaaaauauggcaagaaccucaauuauuuuugcaccauccuaaua

SEQ ID NO: 2252325 - RNA, 68 nt, Homo sapiens
cuuaaggagguagucugucccuuagcagagcuugagugcugugcugggagauccacugcucucuucag

SEQ ID NO: 2252326 - RNA, 61 nt, Homo sapiens
ccugaaaaaccucaguucugcucuuaaggcccuuaaacugcuugaauuggguuuacccagg

SEQ ID NO: 2252327 - RNA, 76 nt, Homo sapiens
uggagugacauguuuacaguguugagagaaauagaacaccaaacuagaauucuguacccuguaaaaauauccuuca

SEQ ID NO: 2252328 - RNA, 57 nt, Homo sapiens
gaauuuugugggaccagagggcagacuuauggguuaaauuguguccccacaaaauuc

SEQ ID NO: 2252329 - RNA, 63 nt, Homo sapiens
agggcccuucucagagcauggcccuuugccgcugcauaggucauguguccaggagguagcccu

SEQ ID NO: 2252330 - RNA, 96 nt, Homo sapiens
uuaugaggacaugagauuugggagggaccagggucagaaugauaugguuuggcuugggccccacccaaaucuuaucuugaauugcaguucucauaa

SEQ ID NO: 2252331 - RNA, 74 nt, Homo sapiens
gcagcuuaaaguguuguaucuccauuugcauauaaccugaauacaaaugcaauucaaugcauauuuuaaguugu

SEQ ID NO: 2252332 - RNA, 62 nt, Homo sapiens
ggguagcaaauggcugucaaguagccaagagggcugagaguugacaaggagccauugcaucu

SEQ ID NO: 2252333 - RNA, 91 nt, Homo sapiens
gccuuuguuucuucaucugucaugugaggauaacaauagugcccaucuuguagggugguugugagacuuaaaugagaugauggagcugggc

SEQ ID NO: 2252334 - RNA, 55 nt, Homo sapiens
uuuugggagaggggcugugauucguccaaacuggaucauaugcucacuccuagaa

SEQ ID NO: 2252335 - RNA, 82 nt, Homo sapiens
guuacaguuuuguaccaucaucugguuagugccuuaggauaaauuucuagcagucucagaaugcaugguuaaaagaguauac

SEQ ID NO: 2252336 - RNA, 57 nt, Homo sapiens
uguaacaggaggaaaaugugaacuccccagcagggugguucucagucuuucugugca

SEQ ID NO: 2252337 - RNA, 65 nt, Homo sapiens
aaaauguuagcacuaagaauauauuuuuauauuuuaacuuaggagcuuucuuguguugauauuuu

SEQ ID NO: 2252338 - RNA, 69 nt, Homo sapiens
ggacaagaucuuccaccauucagaaucccacauuauaaucacaauauugcauccugggagauccugucc

SEQ ID NO: 2252339 - RNA, 61 nt, Homo sapiens
uuaagggaggagcuucaagauggcugauuagaaguauuucauguccucuuccuccacuuag

SEQ ID NO: 2252340 - RNA, 58 nt, Homo sapiens
ugagacugagucucgcucugccgcccaggcuggagugcaauggcgugaucucagcuca

SEQ ID NO: 2252341 - RNA, 76 nt, Homo sapiens
guuuaggacaugcuaaguuuaagacauccauuauacauucaaagggagauguugcaauugauguaugucugaagau

SEQ ID NO: 2252342 - RNA, 67 nt, Homo sapiens
guguauguguuuaugggguacaugagaugcuuugauacaggcaugcaaugugaaauaagcacaucau

SEQ ID NO: 2252343 - RNA, 90 nt, Homo sapiens
ugaaaccaucaguuagcauaugcacuguaguuauuagcauuacaaugugcuuauuaucacguguguuuaugcuacgcaaugagucuuuca

SEQ ID NO: 2252344 - RNA, 96 nt, Homo sapiens
uauuuacaacucaggcuauguggaaauggugcuacgaacacgcguguaaaaaugcuuguuugaguaccuguuuucaauuguuuuggguuagaaaua

SEQ ID NO: 2252345 - RNA, 59 nt, Homo sapiens
ugagcugagaucaugcuauuguacuccagccuggggaacaagagcaagacuucaucuca

SEQ ID NO: 2252346 - RNA, 55 nt, Homo sapiens
guacccuggaacaacccaauuuggacugcaaguauuaguugggucuuccaggugc

SEQ ID NO: 2252347 - RNA, 77 nt, Homo sapiens
auacuauugcacuggggguuagaauuucaaucuaaaaauuuugaugaggacacaaacauucagugcauacagagugu

SEQ ID NO: 2252348 - RNA, 105 nt, Homo sapiens
ucagaagucgaauggcccuuggcaaugcucuuuaaccuauucugaagaaguucccuuuaaguuaugaaguagguuaagagcaguagaccaauauuuuguuucuga

SEQ ID NO: 2252349 - RNA, 94 nt, Homo sapiens
ucuauccuauuaguucugucacucuagagaaccaugacuaauacagauuuuuguaccaggagugguucuagagggacagaauguuaaggaugga

SEQ ID NO: 2252350 - RNA, 80 nt, Homo sapiens
gauugcugagcugacuuugauguugguguuuaaugauaaacagauuucagauaacacggcccgcagagcaagcuguaauu

SEQ ID NO: 2252351 - RNA, 69 nt, Homo sapiens
cuuucagcagugccccacucuacugguaccaauuuacuguauuagucuguuuuuacauugcugauaaag

SEQ ID NO: 2252352 - RNA, 57 nt, Homo sapiens
augagauuaauacacaucaaaugcuggcaacaauauuggcggcaguuuuauucucau

SEQ ID NO: 2252353 - RNA, 88 nt, Homo sapiens
ucagaaucccauguagcuaggauuacagauguccaccuuccaccauacccggcuaauuuuuguauuuuuaguauagaugggguuuuga

SEQ ID NO: 2252354 - RNA, 87 nt, Homo sapiens
ucuaaaaucaaugcagcuuuuggagagaaagggcaucaggugcguuaacagcagcuuucaucucucagcagcuaguaauguaaugga

SEQ ID NO: 2252355 - RNA, 100 nt, Homo sapiens
ggcucgcgagggggauacggggaaauggggccuucuccggggcugagcugguugggccgcugcaggauggucccgcgccucaguuucccugucugggguc

SEQ ID NO: 2252356 - RNA, 90 nt, Homo sapiens
ugauuucuuugacuuccagaucauguuguguauugugguguaggcauucauaugucauaguaugaucuuuuggggaguuaaagcgaauua

SEQ ID NO: 2252357 - RNA, 92 nt, Homo sapiens
ugccuacagggagagaauguguuggucaggaugaagccaacaucugguccacuugacacuuauauuacucacuguaaauuaaugaacuggca

SEQ ID NO: 2252358 - RNA, 56 nt, Homo sapiens
agagaguguaggcugggggugggagaauagcacccgucuuacagccagaugccucu

SEQ ID NO: 2252359 - RNA, 85 nt, Homo sapiens
uuaaaagaaaagggugggcugugaguuaacaauuaggugucuuaauacaaguauuugucacuuaacagccauuauuucauuuuaa

SEQ ID NO: 2252360 - RNA, 79 nt, Homo sapiens
caagacagugggggcagaaggcuggcaaccuagcaacaauacucccuugccacuucucuugccccauucuacucuuuug

SEQ ID NO: 2252361 - RNA, 85 nt, Homo sapiens
gaucuguucccuggcaugauguguucauugaaaacccuguauagaggaguuucacauuagauaugucauuucuuuuuaacagauc

SEQ ID NO: 2252362 - RNA, 55 nt, Homo sapiens
gucuugaucuggaaacuggcgccaagucaucugcaccacauuccauugaucaggc

SEQ ID NO: 2252363 - RNA, 117 nt, Homo sapiens
uagggaaaucaccaugcguggaaaucucugugugacuuauaacauggaagaucucauuccaacgcauucuaucagguguaagccacauaaauuucuacuuuuuguugaacuuuccug

SEQ ID NO: 2252364 - RNA, 61 nt, Homo sapiens
ucaggccagucagugaaguuuuucugggccacugacuagauagcccauuuguugguccugg

SEQ ID NO: 2252365 - RNA, 80 nt, Homo sapiens
guaucuccgagcucccagagaguugcuguagugagugcugaaugucuauggcacuaguacuggaaagcaauguggagugc

SEQ ID NO: 2252366 - RNA, 81 nt, Homo sapiens
gagggugagagcuccgauccuuccauauuuuccaggggaggggaucaggaauguauuaaggcauugggccucucuucucuc

SEQ ID NO: 2252367 - RNA, 66 nt, Homo sapiens
cuagugguaauucugugagauggugcagauguaggauauuuccaccggcucaggaaguucuauugg

SEQ ID NO: 2252368 - RNA, 98 nt, Homo sapiens
gguaaguucgaucuuuucuuggugucuuccagucuuuucuguuaugcacuagaugugcuugacuaggaggcuggaggaugaggcuggagagcucuauc

SEQ ID NO: 2252369 - RNA, 84 nt, Homo sapiens
uuaggcuaugaaaccaaagguggggaaagcaccguuuaucaaaagugaucauacggaacugcuccauucuuugcuuauacuuaa

SEQ ID NO: 2252370 - RNA, 100 nt, Homo sapiens
gcaaaaugguauaacugagagauggcauggugcaggguuuaagagcacagucucuagauccuauaugaugcucagucuuggaacucagcaaccauauugu

SEQ ID NO: 2252371 - RNA, 74 nt, Homo sapiens
agagccugcauguggugguagccaggacaggugugggcccucaggucugcuggcgauuccaucagauguacucu

SEQ ID NO: 2252372 - RNA, 84 nt, Homo sapiens
ggagugaaacuaucucaaggguguauauagaaaggugggauuaguugguuacuuucuaaguaagucuguggggaagaagacucu

SEQ ID NO: 2252373 - RNA, 63 nt, Homo sapiens
accuguguuugauugcaaauaaucuacagauaaguggaccuuugcaauucaaaccuguauggu

SEQ ID NO: 2252374 - RNA, 87 nt, Homo sapiens
ucagagacaccucucauuucuccucaaugccacugcacugaugucaacugacuuagggcaggcaugagagaacugagguuuacaugg

SEQ ID NO: 2252375 - RNA, 65 nt, Homo sapiens
ugagauuauauuucuuaacagaaauuuacuuaacugugaggaugcuguguggcaaguauuucuca

SEQ ID NO: 2252376 - RNA, 85 nt, Homo sapiens
gugugccccugcgugcaugcagcacacaugucugugcgugggugaguggacaugcgcugugugcaccugcaugcauguggcacac

SEQ ID NO: 2252377 - RNA, 63 nt, Homo sapiens
uggaguaggccuaagaaugacaagaguuccucuucugggcuggugguucuggaggccacucua

SEQ ID NO: 2252378 - RNA, 60 nt, Homo sapiens
cgcuugaguacaguggcacgaucauagcccacugcagccuugagccccuggacucaagcg

SEQ ID NO: 2252379 - RNA, 87 nt, Homo sapiens
ccaagccuguuucccggcaguggguaagccaagcuugaaaacuugcccaggcuaccugacucccacuugcgaaagaaaagugcuugg

SEQ ID NO: 2252380 - RNA, 91 nt, Homo sapiens
uuuauuagcuuugugcaaaaacaauugcgguuuuugccgcaaguacaaguaauggcaaaaaccgcaauugcuuuugcaccaaucuaauaaa

SEQ ID NO: 2252381 - RNA, 85 nt, Homo sapiens
gagguggaguggguaagcugucuauccugucaaacccagcagucugaguaugacuugagcuggagccugccugcucccaugccuc

SEQ ID NO: 2252382 - RNA, 106 nt, Homo sapiens
gguuguuguaacaagaaggaugacagucucugccuacugagcacacagugugccggaugcugcagcgcaugugggcagagaggccucacucugucucacagcgacc

SEQ ID NO: 2252383 - RNA, 130 nt, Homo sapiens
gccuaugacaucuggguugguuccaagucuuugcuauugugaauggugccgcaauaaacauacaugugcaugugucuuuauagcagcaugauuuauaauccuuuggguauauacccaguagugggauggc

SEQ ID NO: 2252384 - RNA, 83 nt, Homo sapiens
agcucacagcugcaggcuguaauagguuuccagagaccacagcccuaugcuuuugaaaucuuccacagcccaagcuccaggcu

SEQ ID NO: 2252385 - RNA, 69 nt, Homo sapiens
accaagcuaacaacacagcagauuagaaguaccagacuuugcuuuuaguucacuugugcuuguuguggu

SEQ ID NO: 2252386 - RNA, 62 nt, Homo sapiens
uggacaugaagggcacaggaggcuuggaauccugucucugcccuugugaagcuucaaaucca

SEQ ID NO: 2252387 - RNA, 94 nt, Homo sapiens
gcagggaaacucagacucagggaguggaggggcuugggggugggaacccagccccccauguucucucugcagcuccacaccacuguucaccugc

SEQ ID NO: 2252388 - RNA, 56 nt, Homo sapiens
uuuagcagcaaagagccaugcucuguaaaagagauacuggcucucaguuugcuaag

SEQ ID NO: 2252389 - RNA, 92 nt, Homo sapiens
ggcaaccagaagugggagugugcacaauuucagccuuguccaagaacucagcucuacuugguauacucccacuguguucuugguuuccugcc

SEQ ID NO: 2252390 - RNA, 70 nt, Homo sapiens
aaugugaguuuuggggggcaauggguggaaugcuaugguuugaauguuuguccccuccaaagcucauguu

SEQ ID NO: 2252391 - RNA, 58 nt, Homo sapiens
gcuggagggcaggggugugaccauaguucacuguagccucaaauucuuggccuccagc

SEQ ID NO: 2252392 - RNA, 55 nt, Homo sapiens
cuggcauuacaggcgugagccaccgugcucggcugcaaacauccuuugaugccag

SEQ ID NO: 2252393 - RNA, 77 nt, Homo sapiens
acaggacucaaacuccuuauacauagcucuucuaugcuauguauagcauagaagcuauguauaggggccucuucugu

SEQ ID NO: 2252394 - RNA, 90 nt, Homo sapiens
aaaacagaacaaguuugcuuauuagccuuaggucauuucuacccaauacuguuaccauauggcuucuauaaggaagcuuacuucuguuuu

SEQ ID NO: 2252395 - RNA, 58 nt, Homo sapiens
cuguauguuucuaugaaugugacuauuuuagauaccucauguaaguggaagcaugcag

SEQ ID NO: 2252396 - RNA, 55 nt, Homo sapiens
gggacuuagugaagacuuacucccuacuucccuagugaaaucuucacuaagucuc

SEQ ID NO: 2252397 - RNA, 77 nt, Homo sapiens
aggugcauuuguguuucugcaggauucuguggccaaauacugcugguugagaacuggcgugaacugcacgugcacuu

SEQ ID NO: 2252398 - RNA, 112 nt, Homo sapiens
cagaucugcccuggcauuagauucucacaggagcgugaacccuauugugaacuaugcaugcgaggcaucuaaguugcaugcuccuuaugagaaucuaaugccugaugaucug

SEQ ID NO: 2252399 - RNA, 62 nt, Homo sapiens
uggguaagugcacaaaucuuaaauguacaucggcgauguauuuuuacaugugcauccaccca

SEQ ID NO: 2252400 - RNA, 57 nt, Homo sapiens
uuacaauuuauuccuuuuggcggaacauuugaaacauucugucagaguggauuguaa

SEQ ID NO: 2252401 - RNA, 61 nt, Homo sapiens
ugucuuagagauaaagaaugaaguaggaagaaaagaagcuuagauucugaaucucaagaua

SEQ ID NO: 2252402 - RNA, 64 nt, Homo sapiens
guuuuauaaaugccauaggcaugagauguuuacaucuaguuuuaugcuuguuuauuuaagaaac

SEQ ID NO: 2252403 - RNA, 73 nt, Homo sapiens
guugcuuuugcuugaggucuagcuacccuguauagccauguagaacgggaaguacccucaggcaaaaagcagc

SEQ ID NO: 2252404 - RNA, 76 nt, Homo sapiens
gucaucucauugugaucugucuuuccuuauagucucuguucagagaaggaguguacaggucaugcagauagaugac

SEQ ID NO: 2252405 - RNA, 99 nt, Homo sapiens
gaggcagaagaaucauuugaaccugggaggcggagguugcaaugagcugagauugcaccauugcacuccagccucggugacagagugagacucugucuc

SEQ ID NO: 2252406 - RNA, 83 nt, Homo sapiens
ggguggcagcuggguucagagugggcugcggcccuccauaugugaguuucugggcuucaucccucaaacuccagcaaccauuc

SEQ ID NO: 2252407 - RNA, 62 nt, Homo sapiens
ccacucugagcaugacaucaugugacugugacccucaagucaccagucaugcugagaucugg

SEQ ID NO: 2252408 - RNA, 57 nt, Homo sapiens
gauguuacuucaugcucuucuguugcugcauaguauuggagguuguauaaguacauc

SEQ ID NO: 2252409 - RNA, 67 nt, Homo sapiens
uucccacuaaugccaucagagaaaacucuuucugaauacuaaucagaaacucucaugaagugaggaa

SEQ ID NO: 2252410 - RNA, 56 nt, Homo sapiens
uugcaguaguaacuccuuaccuaccaacagggauagguaaggaguuacuacuguga

SEQ ID NO: 2252411 - RNA, 63 nt, Homo sapiens
caguucagcgcauucugauuucaagaagaguguccuucagauggaauacaugucgcugagcug

SEQ ID NO: 2252412 - RNA, 57 nt, Homo sapiens
gccucucugugccuguuuccuucucuaaaauggggaggauaguaaugauagagaggc

SEQ ID NO: 2252413 - RNA, 58 nt, Homo sapiens
gcagggacgugugugugcgugucuguguguguguguguguguaugcacaugccccugc

SEQ ID NO: 2252414 - RNA, 84 nt, Homo sapiens
ucguacccuagacuguugguaacugggauaacuguagugaccuaugaccugugguaaccuauaguuaccaauagugaccuauga

SEQ ID NO: 2252415 - RNA, 58 nt, Homo sapiens
ugcacgugcacccacaugcacgugcacccacaugcacgcgcacccaugugcacgugca

SEQ ID NO: 2252416 - RNA, 86 nt, Homo sapiens
gagucucacucuguugccuaggcuggaaugcaguggcacgaugucggcucacugcaaucuccgucucccagguucgagugauucuc

SEQ ID NO: 2252417 - RNA, 81 nt, Homo sapiens
cacugucucaauugugcuaagguaccagcaguuuuaccuaccagguuuuuuugcacuauuaguauagaugucaauacagug

SEQ ID NO: 2252418 - RNA, 109 nt, Homo sapiens
ugucauuggaguaaugcuaggcucuguauacugaucaaacugagguucauaguuauuuuuaauauuucagcaaugacagccuauauaauaaucuagcuaucuguagaca

SEQ ID NO: 2252419 - RNA, 64 nt, Homo sapiens
ggccaugugaugguaugguggagccaugacuucaauuccugcaucuaccuacugcucacaggcu

SEQ ID NO: 2252420 - RNA, 129 nt, Homo sapiens
gcucacauuccuagcagcuaugcguuguggcugagcacauggccacuaggaauaaagacugcauuucucagcuuucuuuguagcuaggaguggucaugugacucaaugcuggccaauagggaugugagu

SEQ ID NO: 2252421 - RNA, 79 nt, Homo sapiens
ccaugguaauacugugauaucgagcgauugucugggccauugucccacaucuugucuggguacacaguacugaacaugg

SEQ ID NO: 2252422 - RNA, 90 nt, Homo sapiens
gauaggcuagacuaagcuguaauguuugguagguuagguggauuaaaugcauuuugaccuagaauauuuucaguuuaagguggguuuauc

SEQ ID NO: 2252423 - RNA, 58 nt, Homo sapiens
augcugucacugggucccaggggcagguuucugccaucacugcaucacaggacagcau

SEQ ID NO: 2252424 - RNA, 65 nt, Homo sapiens
gaacaucaucaggaauccaggacucaagcuugucccugcaaggucacuggagguuccugaaguuc

SEQ ID NO: 2252425 - RNA, 55 nt, Homo sapiens
uugagauggagucucgcacugucgcccaggcuggagugcauuggcacuaucucgg

SEQ ID NO: 2252426 - RNA, 86 nt, Homo sapiens
gguccucccugucacacgugggcuuacgggauguggggggugguccuccccgucacacgcaggcuuacgggauguggggguggucc

SEQ ID NO: 2252427 - RNA, 82 nt, Homo sapiens
cuacccuggcaccugcuuuucuauuggcauauccacgacaaugcugagcucaguguggggccaggaucagggcucgguguag

SEQ ID NO: 2252428 - RNA, 121 nt, Homo sapiens
caugccuggcuaauuuuuguauuuuuuguagaggcgggguuucaucauguugaccaacuccugggcucaaaugaucugcccgccuuggccucccgaagugcugagaauaaucccaagcaug

SEQ ID NO: 2252429 - RNA, 55 nt, Homo sapiens
ucauugguuuuucaggaguauauuauuuaauuuugauguacuuaagaauuaguga

SEQ ID NO: 2252430 - RNA, 84 nt, Homo sapiens
uauuagguuggugcaaaaguaauugugguuuuugccauuacuuuaaauggcaagaacaacaauuacuuuugcaccaaccuaaua

SEQ ID NO: 2252431 - RNA, 60 nt, Homo sapiens
ggcagaaauguguggcuuauuuauaacuaguuuuggaaguuacaaugagacauuucugcu

SEQ ID NO: 2252432 - RNA, 92 nt, Homo sapiens
ugaggucuuuuuuucauggaauauagucauuuuuauaacauggcagucuuucccugcauuuaaaaugauuuuguucuggaaaugagagcuua

SEQ ID NO: 2252433 - RNA, 83 nt, Homo sapiens
uagucuccuaucugguaaguggcagagcaggguuuugaaaccaaaaucuggguuuuuccauugccgguuuugggcuuggacua

SEQ ID NO: 2252434 - RNA, 79 nt, Homo sapiens
agguuggagugcaauggugaguucucagcuuauugcaaccuuccccucccagguucaagcaauucuccugccucagccu

SEQ ID NO: 2252435 - RNA, 64 nt, Homo sapiens
uguccugcagagguguuugccuucucaguacaccagcuaggcacuucccaacucugcaggcaca

SEQ ID NO: 2252436 - RNA, 64 nt, Homo sapiens
aacugcuguuuggguacugguggguugcaacuauuaaaucuccccagacaagccacuuagaguu

SEQ ID NO: 2252437 - RNA, 55 nt, Homo sapiens
uugagauggagucucacucuguggcccaggcuggagugcaguugcuucaucucag

SEQ ID NO: 2252438 - RNA, 86 nt, Homo sapiens
gagaauugcuugaacaugggaggcaaagguugcagugagccaagauuucgccacugcacuccagccucggugacaaagcaagacuc

SEQ ID NO: 2252439 - RNA, 64 nt, Homo sapiens
cucuuggguagauuuugcagagugggcacauacucauggaggguucuguugaucugccuaaggg

SEQ ID NO: 2252440 - RNA, 78 nt, Homo sapiens
acaccucucagagccucagcuuccccaugugaaaaauggguuuaauguuucacguuggggaguugagugagucaaugu

SEQ ID NO: 2252441 - RNA, 90 nt, Homo sapiens
gaaaucaguauuucuaaguaugguaccacgucuuugaagugacauuuccuggagaugugccugcucugcucuuggaauacuuaagauuuc

SEQ ID NO: 2252442 - RNA, 73 nt, Homo sapiens
ugugaaggugaacuucucuaauuuagugguauagaaacuagguacaaaaacucauggagauauccccuucaca

SEQ ID NO: 2252443 - RNA, 101 nt, Homo sapiens
ugaggcaggagaaucgcuugaaccaaggaggcagagguugcagugagcugagaucaugccacugcacuucagccugggugacugagugagacucugucuca

SEQ ID NO: 2252444 - RNA, 91 nt, Homo sapiens
ggaccugaugucacaguguuuguucaucccagcucugcugcugcguagcuccgugguggugaacaaauuacuuaacccgugccugagguuc

SEQ ID NO: 2252445 - RNA, 56 nt, Homo sapiens
gacaagaaaagauuguuccuguuuucuccuuuuaggaaguaacuaucuuuucuguc

SEQ ID NO: 2252446 - RNA, 70 nt, Homo sapiens
gcaucaguggccaagagcacagauauuggcaucaaucagagcuggaucugcaucuuggcacaacuacugc

SEQ ID NO: 2252447 - RNA, 57 nt, Homo sapiens
cugggagguggagguugcagugagcugagauugggccacugcacuccagccuuccag

SEQ ID NO: 2252448 - RNA, 66 nt, Homo sapiens
guguggccuuuguuucaguuggguaccuguuuaacagaaaucuaggcugggcacaguggcucacgc

SEQ ID NO: 2252449 - RNA, 55 nt, Homo sapiens
ugagccucaguaaagcaaggugaauauaauuguuuagcuguuguuaugagguuua

SEQ ID NO: 2252450 - RNA, 60 nt, Homo sapiens
ggcaucuuccuggauuugucaaguaaggcuugagcucugacagaccuucuggaagaaguc

SEQ ID NO: 2252451 - RNA, 99 nt, Homo sapiens
uuuuucauucucucugcaaucuucauggauggaaaugauuuugauaaguuguugaggcagcaguuucaugucuauucugagugcaaagagacugaaaga

SEQ ID NO: 2252452 - RNA, 87 nt, Homo sapiens
gcuggagguugcacaguaagugauagaauuaggauucaauccugggccauuugacuccaaacccuauacuuuuggugaaccccuagc

SEQ ID NO: 2252453 - RNA, 92 nt, Homo sapiens
uugccuuucuaauuaugacaauuguuuucuuguguagguauuaucaaaaccaguaccacugccgagaaaacagaugaagaggagaaagguaa

SEQ ID NO: 2252454 - RNA, 55 nt, Homo sapiens
guaaggauggugacauacaacugaaucuagcacccagcugauguuacauucuugc

SEQ ID NO: 2252455 - RNA, 62 nt, Homo sapiens
ucacgauacuauucucauucuccauaucuuacuggauuuuggaggacaagcauggauaguga

SEQ ID NO: 2252456 - RNA, 96 nt, Homo sapiens
cuccccaagugcaaugucgaucauggaguuggguucaaggucugugagugauuaccuuugcaucagcucuggauguggcuuugcuuauuuggggag

SEQ ID NO: 2252457 - RNA, 69 nt, Homo sapiens
ucuccucacauguuuuagcauggcuguuaucaaagacacaaaagauaacaaguguugagaauguggaga

SEQ ID NO: 2252458 - RNA, 64 nt, Homo sapiens
gggacagaauggaaagaggugguggucaccuuggccaucacuuugccuccgucucuaaccuccc

SEQ ID NO: 2252459 - RNA, 80 nt, Homo sapiens
gagaaguagugguccaguuuuguuaacauaugguuauccagcugucugagcaccauuuguugagaagacuguccuuucuc

SEQ ID NO: 2252460 - RNA, 78 nt, Homo sapiens
ugggguucauaugagugccaaguuaccuggggaaaccuaacaacuuacaaauucuccagguuuggcuuuauaacuuca

SEQ ID NO: 2252461 - RNA, 55 nt, Homo sapiens
aagucauggagaagguggaggugaguccuggcaugggccagcuucuccgugacuu

SEQ ID NO: 2252462 - RNA, 66 nt, Homo sapiens
uggagguaggugauauguagcagagaagaauauguuaaaaaaucuggaugcaguuaccuauuuuca

SEQ ID NO: 2252463 - RNA, 63 nt, Homo sapiens
ucauggagcuauguuuuuaaaacuggggcaagugcuucaaaagaaaggagcauagugcuauga

SEQ ID NO: 2252464 - RNA, 70 nt, Homo sapiens
guucagugguuaaaagauucuagacucagacaaguguuaucuggaauucuaucuugacuauuuccugggc

SEQ ID NO: 2252465 - RNA, 59 nt, Homo sapiens
aaugugcuguucagaggaguccuaggacacauguggggcuccauucuggguaucacauu

SEQ ID NO: 2252466 - RNA, 86 nt, Homo sapiens
uugcaggugggaagcaguuucucauaugaagugacccaguaagaaugugccucugccuucaaagugagcuccuucucacucugcaa

SEQ ID NO: 2252467 - RNA, 101 nt, Homo sapiens
acgguuucaugaagacagcacaucagguugugaaaggcacauugguuuuagaguuaaacaaaugugcacuuggagccuugcugugcuaacuuccugacugu

SEQ ID NO: 2252468 - RNA, 67 nt, Homo sapiens
ggugaggguugagcuggaauucacacccacaucugggaggugcaaauuccagcucaacuccugcacc

SEQ ID NO: 2252469 - RNA, 74 nt, Homo sapiens
gauuccauucgauuuuauucaaugauuccaauggauuccauuggaaucaucaacgaaugaaaucgaauggaauc

SEQ ID NO: 2252470 - RNA, 56 nt, Homo sapiens
aguaagcacuauguugcuuuguuaaauuaaaugauagaucauauucagugcuuacu

SEQ ID NO: 2252471 - RNA, 58 nt, Homo sapiens
gcucacuaaugaugauggugucuccaagaauuuaggacaucaaauugucauggugggu

SEQ ID NO: 2252472 - RNA, 76 nt, Homo sapiens
agcuccugaaguguucccaguugaaaugauuaguaacugccaguaacucucaagcacugaggaugggucaagagcu

SEQ ID NO: 2252473 - RNA, 72 nt, Homo sapiens
ggacauuauacuaagugaaguaagccaggcacaagaagacaaauauucugugauuccacuuauaugaggucc

SEQ ID NO: 2252474 - RNA, 68 nt, Homo sapiens
uucaauaacuauguuugaguauccauuagcacagacccuaugugagauacuagagauauaguggugaa

SEQ ID NO: 2252475 - RNA, 62 nt, Homo sapiens
gcagguacauuuuaaagggcucagcagagugaaacaaagcugaacucaaccagauguccugc

SEQ ID NO: 2252476 - RNA, 93 nt, Homo sapiens
uucauuccuuuuggcuguuuuugguuguuggguaagaguauaaauaucucuauacugauauuuucaacuagaagccagaaaacugggauugaa

SEQ ID NO: 2252477 - RNA, 62 nt, Homo sapiens
gacuuugucuugcauccuacauacaagcucaaccacaguagaauagggcacgaggcagaguc

SEQ ID NO: 2252478 - RNA, 97 nt, Homo sapiens
gcuuguuggagagcgagaugucaagaccucacauagaggagagacuggccuucucucuauauagugauuuuggugugcuguaaucucagguguaggc

SEQ ID NO: 2252479 - RNA, 63 nt, Homo sapiens
uuuucccagagagggacuucuaaugaacccacacggacuucaaggaguuuucucuuuggaaag

SEQ ID NO: 2252480 - RNA, 72 nt, Homo sapiens
agugcucaugaggcuuaauuaucagugaaaugucuugcuuuagauuucacagcuuaauaaggcucagagacu

SEQ ID NO: 2252481 - RNA, 99 nt, Homo sapiens
cugucaaggauauuaaaaaggaguuauucaguugggcuagagguuagacaagguaucuggccuacaaguaauuuuauuuuacuucguguuacuuggcag

SEQ ID NO: 2252482 - RNA, 70 nt, Homo sapiens
cuuccuacaggugaaguauuacacuaaggguuuuauauaaaaucucauugauccuuauacuuuacggaag

SEQ ID NO: 2252483 - RNA, 101 nt, Homo sapiens
auaucugugcuaaucuguccuaacaauuagcacagauauuagugaucugugcuaauugguuaauaugucugcuaauuguuucucagaauuagcacagauau

SEQ ID NO: 2252484 - RNA, 63 nt, Homo sapiens
ccacugucacaacacucugauggauggugccaaccaaagcguuucauagggugguggcagugg

SEQ ID NO: 2252485 - RNA, 56 nt, Homo sapiens
aaauauguguaaaauaggcuaagggaaauuccucucugagcuuguaaacacuguuu

SEQ ID NO: 2252486 - RNA, 81 nt, Homo sapiens
gugcuugguuucagucaguaguucauggcauuagauggcuacauaucuaaagcauccagauugcuucugauuacugagcau

SEQ ID NO: 2252487 - RNA, 77 nt, Homo sapiens
gccuccugucucucucacuuuggcauaguaaugauggaccucuccugauuuacuauguuucaaagugucucagaggc

SEQ ID NO: 2252488 - RNA, 94 nt, Homo sapiens
aaugcaaucccaguaaucuugccaguuuucuugcuuuuuugaacuucuccaaguugggugaagauugguauauuauugaguauuaaauugcauu

SEQ ID NO: 2252489 - RNA, 57 nt, Homo sapiens
caggagcucuagcuauuuccaugauuacauuucaaaugaaugguuucgggguucuug

SEQ ID NO: 2252490 - RNA, 76 nt, Homo sapiens
aggcauggcauguauucuuauuauuccuacuuuauagaugagaaauugagcaguagagagaauacauaacuugccu

SEQ ID NO: 2252491 - RNA, 85 nt, Homo sapiens
cuaaugguuauaggucuuuuaugaaauauauuugcaaguuguccucuucuaguaagucuuuuaauuaaaaguuuauauucauugg

SEQ ID NO: 2252492 - RNA, 84 nt, Homo sapiens
gugccuguaucuccuucuugggugaaagugggaguuuuuagagauuucuuucuuuucuacuucauuaggaggauugacaaguac

SEQ ID NO: 2252493 - RNA, 68 nt, Homo sapiens
uuugauguccaccucagcccacccuccaaacaugauuuaauugggcuggguuuggcaugggcaucagg

SEQ ID NO: 2252494 - RNA, 61 nt, Homo sapiens
ugugcaaucagcuucauuacauuuuucagcaccuuuaggaacuguagugggaguugacaca

SEQ ID NO: 2252495 - RNA, 57 nt, Homo sapiens
cuuggucuagugguagcgccagugccugggaaggcacccguuacuuagcagaccagg

SEQ ID NO: 2252496 - RNA, 97 nt, Homo sapiens
guauuccuagguauguuauucucuuaguagcaguugugaaugggaguucacucauaguuuggcucucuguuugucuguuauugguguaugggaaugc

SEQ ID NO: 2252497 - RNA, 59 nt, Homo sapiens
uggagugagcucuaagaaacuucagagcccucacuggucaccuuagguagcucauucca

SEQ ID NO: 2252498 - RNA, 56 nt, Homo sapiens
uaaaucgaaacugcuccuggauauuacaaaagugugcagguaggcaguaucauuua

SEQ ID NO: 2252499 - RNA, 61 nt, Homo sapiens
gucccuucugccaugugaggacacaacaaaaugacagcugucucucaaccaggaagugggc

SEQ ID NO: 2252500 - RNA, 56 nt, Homo sapiens
gaauaaggucuaugucucaggcagagcuucucaccuggagaagauggaucauguuc

SEQ ID NO: 2252501 - RNA, 106 nt, Homo sapiens
aaaacucacccacgaccuucaguuacaaucaggagagcagugagcacaacugguuccacaggcaccucacaugcucaccugguguuccugggguucacagaguuuu

SEQ ID NO: 2252502 - RNA, 83 nt, Homo sapiens
ggucuauuuagguuuuggauuucuucaugguucauucuugguaaguugaaugcaucuagaaauuuauucauuucuucuagauc

SEQ ID NO: 2252503 - RNA, 56 nt, Homo sapiens
ucauaggauaugaagguggaaauuuaaguaggaaaauuugccuauuauuccuaugg

SEQ ID NO: 2252504 - RNA, 76 nt, Homo sapiens
ggauuuuguagauaauauaauagguuacagaacaugucaugcguacugugaucaugguauuaaucugcuuucaucu

SEQ ID NO: 2252505 - RNA, 55 nt, Homo sapiens
ccacugggcuagguguuuuggauuugauugcaacccggcacuuucaguccagugg

SEQ ID NO: 2252506 - RNA, 90 nt, Homo sapiens
aaaacacaucagauucucugcccuacagacucagugaccccagcaucauucuagacugaagaaaacgagggcaagaagucuuguaguuuu

SEQ ID NO: 2252507 - RNA, 117 nt, Homo sapiens
ugcagaaaaaugagaggcaagaggccauucuggaauguaaaguuuaugggccguauugcaaauacaaauagcuucuuuacuuucuagaaauaaauaggucugugucuuuccuuugca

SEQ ID NO: 2252508 - RNA, 75 nt, Homo sapiens
ccgggagaccucuggcucuagcugucggugaacacggaaagugguguuugcuuaacguggagccagacuacccgg

SEQ ID NO: 2252509 - RNA, 77 nt, Homo sapiens
ccugcugccccuacucugacauggggggcucgcaggguucacacacguggcccagcguucagggaggggcuuccggg

SEQ ID NO: 2252510 - RNA, 56 nt, Homo sapiens
gggcggggcgagacagccagagcuuuucccggggucucuggguuuuggccacgccc

SEQ ID NO: 2252511 - RNA, 87 nt, Homo sapiens
gagaaucgcuuaaacccaggagguggagguuguggugagccgaaaucacaccauugcacuccagucugggcaacaagagugaaacuc

SEQ ID NO: 2252512 - RNA, 126 nt, Homo sapiens
cuuugucaugcucguugauacacacucccaccuagcgccuugcacucagaagauucaguucauauaucuguuaauugacucuaacugacugagguucccuggaugaggagagcaaugagaacagag

SEQ ID NO: 2252513 - RNA, 68 nt, Homo sapiens
ggacaugcucuccucacauuucccugugucuacaccuggcaacaagacagcugggaaauggagugucc

SEQ ID NO: 2252514 - RNA, 122 nt, Homo sapiens
cucucuguucaaaggaacuaaaaauacauuauuguacauauccucccuucagcuacccacccaccauuacaagaggaacugacagagggaaauguaaaagcuguguaaaguucagcugagag

SEQ ID NO: 2252515 - RNA, 61 nt, Homo sapiens
auccccugcggcucuuuuggcuguaaggacuagaaaugcaguucagaucagcccaagggau

SEQ ID NO: 2252516 - RNA, 111 nt, Homo sapiens
guugaaucauuuguuuuuaaacauaaaucaagcaaaccuuucuuggaacugaaaacuauauuuucccauuaaugugaucauuucaggaauuuugcuaaauagggggucaau

SEQ ID NO: 2252517 - RNA, 78 nt, Homo sapiens
ggggcgacgaugauaucacucccaauaucgcagggguugcacacaccacuugcgauguggggagugagagccagcccc

SEQ ID NO: 2252518 - RNA, 68 nt, Homo sapiens
acagcugacaaagccugaaugugacagggcaagacauuuuaggcagcccucauggcuuuuucagcugu

SEQ ID NO: 2252519 - RNA, 57 nt, Homo sapiens
gcuuugaaaggauuaaaccuguuaucacucaccugcuacagcauagccuuuuaaagc

SEQ ID NO: 2252520 - RNA, 85 nt, Homo sapiens
ugagaagcagugacuucuucuggacuuugguucucuucuuagcccuuuuuccuuggagccgguguccacgaagaagaguuuuuca

SEQ ID NO: 2252521 - RNA, 67 nt, Homo sapiens
auaauauaauagguaguaauggauugauuauagaaucugaucccugguacuaucuauacaauguugu

SEQ ID NO: 2252522 - RNA, 129 nt, Homo sapiens
uaaggacaguuuuauuucuuccuuuccagucucuaggccuuucugguuuucuugucuuauuucacugacgaagacuauucaaaagguuaaauagcgguguuaagaaagaagauccuuguguuguucuua

SEQ ID NO: 2252523 - RNA, 59 nt, Homo sapiens
ugagaccgaguuuugcucuuguugcccaggcuggagugcaauggcacgaucuuggcuca

SEQ ID NO: 2252524 - RNA, 67 nt, Homo sapiens
gccaaguuaguuauugugaauuuuaguuuucuuauuuaugaaauggggauuguaauacugaguuggu

SEQ ID NO: 2252525 - RNA, 84 nt, Homo sapiens
gaggaaaccuguguucacagaggcuaagugccaggugcaccgugagccccuauggcauuuugugugaauuagaaaacuuuccuc

SEQ ID NO: 2252526 - RNA, 63 nt, Homo sapiens
cuggacuucucaucgguuguucuagaugguggaagacuaugcagcaaugucacagggguccgg

SEQ ID NO: 2252527 - RNA, 85 nt, Homo sapiens
cagcagcgaggucugcgucacauugccgucacauucccgaaucugugauuccaaagcaagugaacgcaucaccuccagcccuuug

SEQ ID NO: 2252528 - RNA, 58 nt, Homo sapiens
gugugagauggugaauuuguguuguuuuaagcacuaaguucaugcucaucuguuacac

SEQ ID NO: 2252529 - RNA, 72 nt, Homo sapiens
ggcaggauuuguugugugauucaucagggcagagaagcaguuugaggaaaggcauaaguagggcaucuuguc

SEQ ID NO: 2252530 - RNA, 130 nt, Homo sapiens
uuugcauuaaggaaggagguccuuucccccuuucuggaaagaaacccuuaauucuucugguaucauugugcuggagaagacagagguuuauuucagggaguggggagccccuuuuccuuaggaugcugca

SEQ ID NO: 2252531 - RNA, 67 nt, Homo sapiens
gcacccagcccucauucuccugguuuuugauaagaaauaugaagcugccaggcaugguggcuggugc

SEQ ID NO: 2252532 - RNA, 85 nt, Homo sapiens
cuggagagugagguugucagugucauucuugcacugucuggcagaaagaauuaucugaugcugauaacuaguccugauuauccag

SEQ ID NO: 2252533 - RNA, 85 nt, Homo sapiens
aguugucugguaccuggcucugagguguuuagggcugguggaccguggccuagaaggugagagccagaagaagugcuggggaacu

SEQ ID NO: 2252534 - RNA, 65 nt, Homo sapiens
ugguggauguuaaguauucucaccacaaaaaugauagcugugugagguaguuaaugcauucacua

SEQ ID NO: 2252535 - RNA, 61 nt, Homo sapiens
ccucagaagaaguggaauugaugcucccuuuaccuucuaagcaucaaacugcucuuugagg

SEQ ID NO: 2252536 - RNA, 59 nt, Homo sapiens
uccuuaauucucaaggcauaugaaauggucacguuaucaaguuggaagagaaguaagga

SEQ ID NO: 2252537 - RNA, 74 nt, Homo sapiens
guggugcaagcuguugguggaucuaccauucuagcaucuggaggaugguaggccucuucucauagcuccauuac

SEQ ID NO: 2252538 - RNA, 84 nt, Homo sapiens
uucuguuuucccucuacauaaauguaugccugucagaugggucaagacguacaauguauauuuuacuguaggcugaagucagag

SEQ ID NO: 2252539 - RNA, 68 nt, Homo sapiens
uaacaucuguucacaguguuucuuugagauaggaacuauaauugucuuaccagcugagaagaggguua

SEQ ID NO: 2252540 - RNA, 89 nt, Homo sapiens
guuuuuugguagcauuuuuugcuuuauucugcucgugcauauuuuggaaugaggugaguaaauaaaugaaugaacaaacaaauaagaac

SEQ ID NO: 2252541 - RNA, 60 nt, Homo sapiens
ucuguaaugccccaagagaaagauuugagccuaaguaguuuucuuggaggcgaucuuaga

SEQ ID NO: 2252542 - RNA, 60 nt, Homo sapiens
uugugguugauacacguaggaauucccucagugucauggaagccuacuagucagcuauaa

SEQ ID NO: 2252543 - RNA, 59 nt, Homo sapiens
cugaggaaguucuuuaacaguucuugcaggacauaucuacugcuaaugaauucccucag

SEQ ID NO: 2252544 - RNA, 65 nt, Homo sapiens
uuuuugcaauuagccuaacaugaggcccagucucuacaagucaccucauguuauguuuguagaag

SEQ ID NO: 2252545 - RNA, 56 nt, Homo sapiens
uaggagcacagcagcauguggguccuucacucaucuacacccugaaaauguucuug

SEQ ID NO: 2252546 - RNA, 64 nt, Homo sapiens
guaaucucagcuacgcgggaggcugaggcaggagaaucgcuugaacccgcgagguggagguugc

SEQ ID NO: 2252547 - RNA, 129 nt, Homo sapiens
ccuuggcuucucaauguguggggaauauaggcaugagccaccccacuggcuauaaaaaguaauuuuaaaaauaguuaggccagaugcgguggcucacaccuauaaugccagcacucugggaggccaagg

SEQ ID NO: 2252548 - RNA, 63 nt, Homo sapiens
cuucucccacccucauuuuuaggcagcugauuauuucuaugccagaacugagagguggggaag

SEQ ID NO: 2252549 - RNA, 84 nt, Homo sapiens
ugggucaaaugguauuucuaguucuagaucccugaggaaucaccacacugucuuccacaaugguugaacuaguuuacagaccca

SEQ ID NO: 2252550 - RNA, 83 nt, Homo sapiens
gguggaggauuucuguguuauggaguauaugugaacugaacuugaacaaguacuagcagacuguucuucauaacuccugugcc

SEQ ID NO: 2252551 - RNA, 66 nt, Homo sapiens
cucaguguuuuauccuccagagcccacucuagaauccucgcaggggcucuaagaggaaggccugag

SEQ ID NO: 2252552 - RNA, 57 nt, Homo sapiens
cuuucuccaaucuaagggaagaaggccugguuuuuguauguuggagauuggagaagg

SEQ ID NO: 2252553 - RNA, 56 nt, Homo sapiens
cacaacacugcaugucuagcuccauggcugaguccaggcaagacccaaagugugug

SEQ ID NO: 2252554 - RNA, 84 nt, Homo sapiens
ccuuggccucccaaagugcugagauuguaggcaugagccacuugcccagccugcacagaacuuuuaauaauggaagcuuuaagg

SEQ ID NO: 2252555 - RNA, 74 nt, Homo sapiens
ggaccugcagcaggcauauagcacuaggcucugggggcagugccuagugcuauugugcccucagugugagguuc

SEQ ID NO: 2252556 - RNA, 69 nt, Homo sapiens
auggacgaggccaagguuuucauccccuacguaaugggaaugauauuuaaacuggcccaauuguuccau

SEQ ID NO: 2252557 - RNA, 64 nt, Homo sapiens
auugugaauagugccgcaauaaacauaugugugcaugugucuuuguagcagcaugauuuauaau

SEQ ID NO: 2252558 - RNA, 67 nt, Homo sapiens
uggaauuauaggcaugagccaccacgcccggcggaugauggcauuucauguuuguaaaauuguucca

SEQ ID NO: 2252559 - RNA, 129 nt, Homo sapiens
uagucugcaccucaaagcguugcugugaagauuaaaugagcuaauauggguaaguugcuuaguucagcaccuccucaacucucauuguuaguucuugauagaaucaucaaugcgguaagaugcauacua

SEQ ID NO: 2252560 - RNA, 129 nt, Homo sapiens
cucaguuuguaaaaccucauuuugaacuucaucuacaagguaucagugaccguaagcuaauuuuuuacuuucucggugccuuugucuccuaggucucaaaacggugugguucuuuuaagauaaauugag

SEQ ID NO: 2252561 - RNA, 73 nt, Homo sapiens
uaaagagugagaguuucugcaacuguauucugaaaguauugacagagcuguuguuaauuaacucauuucuuua

SEQ ID NO: 2252562 - RNA, 71 nt, Homo sapiens
gucucacuauguuggccaggcuggucucgaacuccuggguuugagcaauccuccugccauguagcugggau

SEQ ID NO: 2252563 - RNA, 58 nt, Homo sapiens
uccugugagauaauguguaccaggucaaauuuaauuuuggucaguuuucucacuagga

SEQ ID NO: 2252564 - RNA, 78 nt, Homo sapiens
gaagggaacgagcuucgguggugacugcaucccucacauccgaggagggugagaugcucgccggccagcauucccuuc

SEQ ID NO: 2252565 - RNA, 67 nt, Homo sapiens
uucuuuagguguuauaguucaagauauaaagagaagacuuuaggcugaacuuaaaauauguaaggag

SEQ ID NO: 2252566 - RNA, 72 nt, Homo sapiens
ggaugagaugaauaccgacgauguagaaaaacugggcuaaacaauuuauauaaguacugcuucaucucaucc

SEQ ID NO: 2252567 - RNA, 111 nt, Homo sapiens
gucucagaacuguggcauauucuauugaacuggaucagaaggccuucuguccuuguggauaauuguggucuugcuuuuaguuuuuauagauuacuucaauauuucucaggc

SEQ ID NO: 2252568 - RNA, 55 nt, Homo sapiens
uucccuuugugcauaggauuugucuuccuuuauucaucuuucugcaucuggggag

SEQ ID NO: 2252569 - RNA, 101 nt, Homo sapiens
ugagaugggaagaucgcuugaacccgggagguggagguugcagugagccaagauugugccacugcacuccagcuugggugacagagugagacucugucuca

SEQ ID NO: 2252570 - RNA, 62 nt, Homo sapiens
agcacccuggaagaaaggugcuaaauacuuaguauuauggugacuuugcuuucaacuguguu

SEQ ID NO: 2252571 - RNA, 92 nt, Homo sapiens
aauguugaauagaagugguaugagaagacaucuuugcuuuguuccauaucuuagggaaaagcauucagucuuuuaccauuuuuuguaauguu

SEQ ID NO: 2252572 - RNA, 59 nt, Homo sapiens
aaugaccuaauuuggaaagaggaucuuugcagauguaaucaaauugaaauuaggucauu

SEQ ID NO: 2252573 - RNA, 62 nt, Homo sapiens
ugagauuuggguggggacacagccaaaccauaucauuccaacucuggccccucuaaaucuca

SEQ ID NO: 2252574 - RNA, 89 nt, Homo sapiens
ccuccugggguggucucugguucugcagugcacccugcccuauugugguggccucaggggugagaaaucaagacccacccagugcgagg

SEQ ID NO: 2252575 - RNA, 59 nt, Homo sapiens
agcaagaaugaacucucccagagccucuuaccagccgcauuuggaagccaugucuugcu

SEQ ID NO: 2252576 - RNA, 81 nt, Homo sapiens
gggcugauuacaagguacacuuaaacugcuaaaaugauaguucauguuauucauagugcuaagguguaucugguaaugccc

SEQ ID NO: 2252577 - RNA, 68 nt, Homo sapiens
ccaaaagaaagcugguauagauacauuagaagcaaugauauuuuaauuaucaccgguuuauuauuugg

SEQ ID NO: 2252578 - RNA, 79 nt, Homo sapiens
uuuuuccauagauagauagguagcaucauugauuugaaauaaauuaaauugcauugagcugcuuauuaauccagagaaa

SEQ ID NO: 2252579 - RNA, 81 nt, Homo sapiens
caucuauaaaauagguuuaauaguaucucauuuucuauuuaaggaguugugagaaucaaacuacauaaaucugugaagaug

SEQ ID NO: 2252580 - RNA, 79 nt, Homo sapiens
ccaagagucuccagaccuauagugaacuuugugagaacaagaaauaaacauuuguucuguuaaaucacugagacauugg

SEQ ID NO: 2252581 - RNA, 56 nt, Homo sapiens
guauaacuauagagaauguugaguagaguuguuuggcuuugcuucuauagcuguau

SEQ ID NO: 2252582 - RNA, 94 nt, Homo sapiens
guacucuucgggauuagaauuucagaaaggggaagucaugccaccaacuuuuguaacucucccauccaugaacuucuguucuugacaguugugc

SEQ ID NO: 2252583 - RNA, 56 nt, Homo sapiens
uugagggaggcagggcuugucuucugucuucagagcagggccugacaucuccccag

SEQ ID NO: 2252584 - RNA, 72 nt, Homo sapiens
ugcauagggaagugugcuaugcauuuaagacacaagaauaaaugugauggaugugauggcugcuuccaggca

SEQ ID NO: 2252585 - RNA, 64 nt, Homo sapiens
aggauguaaugcacucccaaagauccaagggaagcccuuggaauaugcaauugcauuucauucu

SEQ ID NO: 2252586 - RNA, 56 nt, Homo sapiens
ugccaguguugccuuucacuagagauuacaucuaugacaaaaguacagcacuggca

SEQ ID NO: 2252587 - RNA, 66 nt, Homo sapiens
ccaguccuuggcucggucuugugcucagggccuuccuugacuacaccacacgguuaaggcugcugg

SEQ ID NO: 2252588 - RNA, 67 nt, Homo sapiens
uagcuacauaauagagagauaucauggguuaaaaaccauuaaugauaagaaauuguucauguagcua

SEQ ID NO: 2252589 - RNA, 129 nt, Homo sapiens
cauucccugagauaggucacucucccuuucugaagcucugacucuucaucgauaagauagggacacuaaucuucucuugaaggguggggaagauaagaugaagugguaagugacuucacauaguggaug

SEQ ID NO: 2252590 - RNA, 71 nt, Homo sapiens
cuggggcagucgcguugguacuucagguagaauacaccucguaccugguuuucucacaguggcuggccugg

SEQ ID NO: 2252591 - RNA, 61 nt, Homo sapiens
ucccucuacuccucaaagugaauuccuucccgucuggauaagacuuuggugauuagaggga

SEQ ID NO: 2252592 - RNA, 61 nt, Homo sapiens
uuggucucuaucugcuacauacuauuggcaccccaacacccaugugcaguguggcaaccaa

SEQ ID NO: 2252593 - RNA, 75 nt, Homo sapiens
cuguggacaacaggaguuuuguuagugcucuucagggucccggagaucauguacuagaacaccuuuccuccacag

SEQ ID NO: 2252594 - RNA, 88 nt, Homo sapiens
caaagugacagcgauucuggcuugugaacugucuucucacuugggacugagauuaacagcauacaggucaauuauugcugucauauug

SEQ ID NO: 2252595 - RNA, 63 nt, Homo sapiens
ucaucuuaacgagaugaaugguguaucaaagaaacuaugacuacacacaauuugucaagguga

SEQ ID NO: 2252596 - RNA, 59 nt, Homo sapiens
ugagaagaugaacuccuuggucugccuucucugccgacgccuucacgagugucuucuca

SEQ ID NO: 2252597 - RNA, 56 nt, Homo sapiens
uccguuguuauccaguguuacgauaaagugugaugguaacauguuguggcagggga

SEQ ID NO: 2252598 - RNA, 83 nt, Homo sapiens
uuugguuacaugcguaaauuguuuaguggugauuugugagauauuggugcacccaucaccugagcaguauacacugaacuaaa

SEQ ID NO: 2252599 - RNA, 90 nt, Homo sapiens
gcaccaucaaggcaggcaacacugagugcuaugaacaaagauaaagugggcaauggaauggcauguuggguguugacuccgagaaggugu

SEQ ID NO: 2252600 - RNA, 83 nt, Homo sapiens
gcugucucucauuagccauaggguguguugugguguccagugugacauuauuagguuaaccuauagcuacaugugaugauagu

SEQ ID NO: 2252601 - RNA, 80 nt, Homo sapiens
gugucucuguugccuaggcuggagugcaguggcgccaucucgguucacugcaaccucugccucccggguucaagcgauuc

SEQ ID NO: 2252602 - RNA, 62 nt, Homo sapiens
uagaucgcugagaaagggacuuucacuucuuccugccucgguggcucccuuuccagugucua

SEQ ID NO: 2252603 - RNA, 64 nt, Homo sapiens
auugugaauggugccacaauaaacauacgugugcaugugucuuuauagcagcaugauuuauaau

SEQ ID NO: 2252604 - RNA, 66 nt, Homo sapiens
cagacugucaugggguacuacacauggggggucagcacucccgugggucacucacauggggguuug

SEQ ID NO: 2252605 - RNA, 55 nt, Homo sapiens
uuagacaguggugcacugcacuccagccugggcaacagagugagacuuugucuaa

SEQ ID NO: 2252606 - RNA, 66 nt, Homo sapiens
uaacauggcuguguuccaauaaaacuucacaaaaaacggcaggauuugguccacaugucauaguua

SEQ ID NO: 2252607 - RNA, 73 nt, Homo sapiens
agugccgugggauauaaucaguccuguaaauucaucagaauguucuguugccugauuuuuuuuccauugcauu

SEQ ID NO: 2252608 - RNA, 57 nt, Homo sapiens
gaguaagucucaugagaucugaugguuuuauaaauugcaguucuccuggacaugcuc

SEQ ID NO: 2252609 - RNA, 55 nt, Homo sapiens
uuagggaggcucaggacaagaggcugaggcacaacuuuccuccaagccucccuaa

SEQ ID NO: 2252610 - RNA, 68 nt, Homo sapiens
ugugacauuuuuacugaugagaguucuaguaacaguuaacucaaguuuucuccuacagaagagucaca

SEQ ID NO: 2252611 - RNA, 76 nt, Homo sapiens
uauuuucagauacuccuggucucaggaggaggaguguuucuggucuuucucucugaggaaggagcaucugugaaug

SEQ ID NO: 2252612 - RNA, 68 nt, Homo sapiens
cugugccauuaggcgauuuuguugugugaacgucauggaguacacuuagacaaaccuagaugguacag

SEQ ID NO: 2252613 - RNA, 87 nt, Homo sapiens
ggagaauugcuugaaccugggaggcggagguugcagugagcugagaucgugccacugcacuccagcuuugggugacagcaagacucc

SEQ ID NO: 2252614 - RNA, 69 nt, Homo sapiens
gauuguuucuuucucugugagucauuuugaagaaauagaaugauccuucucagaggcacaagauagguc

SEQ ID NO: 2252615 - RNA, 61 nt, Homo sapiens
uuucccgcugauacuggauaggcuagcaguggauauuagccuauccaauaucagugagaaa

SEQ ID NO: 2252616 - RNA, 83 nt, Homo sapiens
ucuugaacuccucaccucaaaugaucugcuggccucagccucucaaagugcugggauuauaaguagcauugugaaauucaaga

SEQ ID NO: 2252617 - RNA, 77 nt, Homo sapiens
gcuuugcccugagaugcuguuaaucuguaacuuuagccccgaccuugagcucacagaaacauguguuuuauggaacc

SEQ ID NO: 2252618 - RNA, 64 nt, Homo sapiens
guguuucuaguuagauccuugaggaaucaccacacuguuuuccacaaugguugaacuaguuuac

SEQ ID NO: 2252619 - RNA, 94 nt, Homo sapiens
gaagcauggcuggguuauuauauuuuucaggguuaucauggaaacugaccauaccguccuucugguuaauacuugcaaaaaucucaccaucuuc

SEQ ID NO: 2252620 - RNA, 66 nt, Homo sapiens
gcagugcaguggcgcgaucucgacucacugcgagcucugccucguggguucacgccauucugcugc

SEQ ID NO: 2252621 - RNA, 98 nt, Homo sapiens
gaggcaggagaaucacuugaacccgggaggcguagggugcagugagccaagaucaagccacugcacuccagccugcuggcagaacgagacuccgucuc

SEQ ID NO: 2252622 - RNA, 98 nt, Homo sapiens
uguaggauacuauuccucuggauauaaaaguucugaaacguuuguuaaaaaucauuauaguugugucuugaauuuuguauguagcauuaguucguaua

SEQ ID NO: 2252623 - RNA, 59 nt, Homo sapiens
uuucuaaguaguagcuggucagaaauuuaugcaucuguuucuuagcuauuacuggggaa

SEQ ID NO: 2252624 - RNA, 59 nt, Homo sapiens
gaucaaguguuuccuuaaauacuuggcauaacgccuggugaauaagaaauacuucaauc

SEQ ID NO: 2252625 - RNA, 74 nt, Homo sapiens
cucagccauuagaaguagagguagagugacuuccccagcugugugaccuugggaagucacucuaccucucugag

SEQ ID NO: 2252626 - RNA, 63 nt, Homo sapiens
ucuggccacagucuuuggcaucaaaagagaacuagggcagaagucaaagacauggcugucaga

SEQ ID NO: 2252627 - RNA, 62 nt, Homo sapiens
gugggguuucugagccuguuagaaagugacauucuuuacuuaucacaggucaggaaccuugu

SEQ ID NO: 2252628 - RNA, 56 nt, Homo sapiens
agagguuuuggggcugagagcuuggugggcacgggcugccagcugucccggcuucu

SEQ ID NO: 2252629 - RNA, 69 nt, Homo sapiens
cauuguuaagugacucaugacuguauuaggguccaggaggcacccuugguuucauagaucaugacagug

SEQ ID NO: 2252630 - RNA, 68 nt, Homo sapiens
ggagcuagucaguuugguuaaucauuccauagauuuaccuaugugaggccccagaacuggcugacucc

SEQ ID NO: 2252631 - RNA, 72 nt, Homo sapiens
ggggcaccauaaugucuguuugcugagcccggcaggcucuggagccgcuggugagcgcacagacacagcccc

SEQ ID NO: 2252632 - RNA, 83 nt, Homo sapiens
gccugggcaacauagugagaccccgucucuacaaaaauuuaaaaauuaaccagucacggugguuugcacuuguaaucccaggu

SEQ ID NO: 2252633 - RNA, 67 nt, Homo sapiens
uguucuaaggaguagaggaauagcaaugaauguuuucauugcuucauuuuuguuauuuuccaggaca

SEQ ID NO: 2252634 - RNA, 55 nt, Homo sapiens
augagaugaggaauggcccuccaggagagccagaggcuauuuccacucuucucau

SEQ ID NO: 2252635 - RNA, 64 nt, Homo sapiens
acugauggcagaugauaguaauguuauaaaaauuaaacaccauuaguaguagcugcaugucagu

SEQ ID NO: 2252636 - RNA, 113 nt, Homo sapiens
cuucuucugaaaagcuggaauaaauucucaaaaugacuuuuuaugcagaguaguucauugaauucuuccugcuuuccagaggcauugaaauuguucccauuuugcagaugagg

SEQ ID NO: 2252637 - RNA, 130 nt, Homo sapiens
cuauagccacaaaaaauuaguuaaugaauauacaauaaaaaauggcuuuuaauauccauaauauaaaguguauuuagggggaguaaaaguauuuuuguaugugauugaaguucuuaucagcugaaaauag

SEQ ID NO: 2252638 - RNA, 102 nt, Homo sapiens
gguuuauuauagauuuagggaguacaagugcaguuucguuacaugugaauauugcguaguggcgaagucugggcuuuuagugcagccaucacuaguguagcc

SEQ ID NO: 2252639 - RNA, 68 nt, Homo sapiens
uggaaaguacugagguccaccugaaguguuugaucacuaacuuuggguaagccagucauacuguuuca

SEQ ID NO: 2252640 - RNA, 82 nt, Homo sapiens
cuccauaauauagacacuauugguugcuaauuggcgccaguaggcuggugcuaauuguccuaaugcacucugcuugauggag

SEQ ID NO: 2252641 - RNA, 58 nt, Homo sapiens
uuacuguuccucucucaaagaggcuuucucuggaagccucucugcuuaugaauaguga

SEQ ID NO: 2252642 - RNA, 67 nt, Homo sapiens
uuguacuccauguucuuaauggcuggaauuagccacauggccauagcuagagaggcuggggauacag

SEQ ID NO: 2252643 - RNA, 63 nt, Homo sapiens
uuuuucuuucuucccguaauaaacgaagggggcuucgcaugggauugugggaggacagagggg

SEQ ID NO: 2252644 - RNA, 82 nt, Homo sapiens
caccgggaugcuaaguagcagaggcaagacuugaaccaaggaugacuugagucuaaacucuuugcuauuaaauccccuggug

SEQ ID NO: 2252645 - RNA, 57 nt, Homo sapiens
uuucuggcuuuuaaagaaauguuucuggacugcagagcagaaaaagaaggccagaga

SEQ ID NO: 2252646 - RNA, 60 nt, Homo sapiens
guuguacacauaugugggguacaugugauauuuugauacauguuuacaauguguaauaac

SEQ ID NO: 2252647 - RNA, 129 nt, Homo sapiens
ugccacaacaauugcaccaggcacuggauaggaaaaaauaagaccaagauuuggccucugcucucaagaugcaauuuugagaguggaggcuauaucuuacgcuucuuugcuaauccauggugcuuggca

SEQ ID NO: 2252648 - RNA, 76 nt, Homo sapiens
gguccccuuagguaccuuaucaauuucucucgucucuucaguggggcuagagacaaguugcugagaaaucuaaacc

SEQ ID NO: 2252649 - RNA, 66 nt, Homo sapiens
agcacaucaagggagcaggcucagggucuacucagcagacgugauaucugagccugccccagugcu

SEQ ID NO: 2252650 - RNA, 90 nt, Homo sapiens
uuucagguaucuuuauagcagugucccacuccuugguaccaauuuucuguauuaggccauucuugcacugccauaaaaaaauaccugaga

SEQ ID NO: 2252651 - RNA, 87 nt, Homo sapiens
uucagcuugagaauauuugaagauguuagaagagggaaaaaauuccaaccaagaaucauauugauauuuaaaauauuuucaguugag

SEQ ID NO: 2252652 - RNA, 115 nt, Homo sapiens
ggcugucucccuaguugugacuagcuuggcuuuuguuauuuggaagcuaaauuccaaaagugagcauaccaggcagcaaaggcagaagcuguaauucuccuagggccuacuagcc

SEQ ID NO: 2252653 - RNA, 85 nt, Homo sapiens
aucacuaccccuacaacuuugaaaucuuugaugguggcauuaauuucuguaauuuccccagaaagauuuuuagaggggaaguggu

SEQ ID NO: 2252654 - RNA, 57 nt, Homo sapiens
cagcuguuguuaugucugcaggggaaucacagucuuuggcagccccuuacacagcug

SEQ ID NO: 2252655 - RNA, 73 nt, Homo sapiens
guuuaagccucuaagagucagguacugucugucagggaagcuuuggcaugauccuagauucaacaggagaagc

SEQ ID NO: 2252656 - RNA, 56 nt, Homo sapiens
cugaggacaucagggaagcauccucagaggagaagauuguuuaauugagucuucag

SEQ ID NO: 2252657 - RNA, 63 nt, Homo sapiens
cauggauuuuuuugaauggcaguuauccaaguauggucuaggggcccuucgggggagucuaug

SEQ ID NO: 2252658 - RNA, 65 nt, Homo sapiens
uguaguccuagguacuuaggaggcugaggcagaggaucgcuugagcucagguauuugaggcugca

SEQ ID NO: 2252659 - RNA, 60 nt, Homo sapiens
ggcgauaaccacguuuacccuucauuaaaguguuuaugagcaguaaauguaucuauugcc

SEQ ID NO: 2252660 - RNA, 63 nt, Homo sapiens
uauuagguuggugcaaaaguaauugcaguuuuuaauggcaauuacuuuugccccaaccuaaua

SEQ ID NO: 2252661 - RNA, 72 nt, Homo sapiens
guagucagguaucaggcacacauuggaguuugcugugcagacucagugagugugcuuggaaucaaugacuac

SEQ ID NO: 2252662 - RNA, 64 nt, Homo sapiens
uucaguuugccaguauuuuauugaggauuuuugcauugauguuuaucagggauauuggccugaa

SEQ ID NO: 2252663 - RNA, 78 nt, Homo sapiens
agcaauuguauagaucguagaccaauaaaaguuuuuucagguuggaguauuuuauuacugcauuuguuuauaauugcu

SEQ ID NO: 2252664 - RNA, 64 nt, Homo sapiens
auugugaauagugcugcaagaaacauaugugugcaugugucuuuauagcagcaugauuuauaau

SEQ ID NO: 2252665 - RNA, 66 nt, Homo sapiens
uuuucuugucuguuccaaagggcaagcagcuuuuuucgucuguuugcuguguggaguagcagaaaa

SEQ ID NO: 2252666 - RNA, 79 nt, Homo sapiens
gcuucaguaaaugugacagguauccuguguucucagcaacugcugcaggauucucuggcaucugcacuuuggcuggagu

SEQ ID NO: 2252667 - RNA, 101 nt, Homo sapiens
cuaggaacuggaagcaaggaaggugagaauuugucaguguggcuucaucacuaccuauugguggaagacacauaccugauaacuacuuugcuaguucuuag

SEQ ID NO: 2252668 - RNA, 64 nt, Homo sapiens
ucucuugugggcauuuagugcuguaaauuucccucuacacacggcuuugaaugcgucccagaga

SEQ ID NO: 2252669 - RNA, 58 nt, Homo sapiens
gugaauagugcugccauaaacauacgugugcaugugucuuuauagcagcaugauuuau

SEQ ID NO: 2252670 - RNA, 96 nt, Homo sapiens
ucucccccauuccccuagagcuacagcccucacugucccgugaggggaaaaggcauggugacaaugggggcuguagcccuaggagaacgggggaga

SEQ ID NO: 2252671 - RNA, 94 nt, Homo sapiens
gucuaagaguguggcugaugagcugcuguuauucaucagaacugggaaacagugaauauccauucugugcuaacugcaggccaggcuccgagac

SEQ ID NO: 2252672 - RNA, 116 nt, Homo sapiens
uuauuuaaucuuuauuaaauuaaauucuuuauuuguaaggcagggccaguaaaaccauaaauauuacuggcucugcuuuacaaacagggaagcacauguuccaagaaguuaaauga

SEQ ID NO: 2252673 - RNA, 77 nt, Homo sapiens
ucgauacauugucauuguacauaaguauggaguacaauuugguguuucaauaaauaucuacguuguauaaugaucga

SEQ ID NO: 2252674 - RNA, 63 nt, Homo sapiens
acugcauuugguaaagucaagaacaaaauaaagauggcccucuugcuguuuucccaaugcagu

SEQ ID NO: 2252675 - RNA, 55 nt, Homo sapiens
aauauccauuacuggucuaaaguaaugggaaacccuauagucaguaguuuguauu

SEQ ID NO: 2252676 - RNA, 63 nt, Homo sapiens
ggauugcuuaagaaguuucauuguguugauuuucaaccuugucguggaucuuguugagcuucc

SEQ ID NO: 2252677 - RNA, 106 nt, Homo sapiens
aguuuuaauuuuauuuggcaugauugcaaauguuauuuugguuucugcauacucacuguuaguauacagaaaugggauugauauuugugugcugaccuuguaaacu

SEQ ID NO: 2252678 - RNA, 55 nt, Homo sapiens
ugggcaaaugcuuuuuagucaauccuaggauucuauucuaagaggucguuucuca

SEQ ID NO: 2252679 - RNA, 114 nt, Homo sapiens
agaugucuagaaaaauuuguauaugucauaucagugaaagugaaaucuccggacaaggcucucuggagguuuuacuuuuacugcaccauagauagaacaguaaaccuggaaucu

SEQ ID NO: 2252680 - RNA, 72 nt, Homo sapiens
ggccuucuuaaguauuaggccccaggcugggcccgcuggcucacgccuguaauccuagcacuuugggaggcu

SEQ ID NO: 2252681 - RNA, 71 nt, Homo sapiens
uacuaugcucaguaccugggugacaggauuauuuguaacccaaaccuaccacccagguacuaugcuuagua

SEQ ID NO: 2252682 - RNA, 61 nt, Homo sapiens
ggauuagggugggguggccaguuuuuugugucuuaugcaaauggcacaccuagcccuaacc

SEQ ID NO: 2252683 - RNA, 55 nt, Homo sapiens
auuaacgucaaaguucuacugguuuuucaaggcuggauggaauguuuggguuaau

SEQ ID NO: 2252684 - RNA, 90 nt, Homo sapiens
uuguucgauacaaggagcuuugaaaguuuccgguucuuaguacauauggaacacuuagauuuuuaagguuuuuuuaauuguuuuagacaa

SEQ ID NO: 2252685 - RNA, 73 nt, Homo sapiens
aauacaaauaaagugcuuaggauaguguguggcauacguuaggugcuacauaaauguuagcauugcauguauu

SEQ ID NO: 2252686 - RNA, 101 nt, Homo sapiens
ugaggcaggagaaucgcuugaaacuggaaggcagagguugcagugagcugagauugcgccauugcacuccagucuuggcaaaagagcgaaacuccgucuca

SEQ ID NO: 2252687 - RNA, 102 nt, Homo sapiens
ugagacagaguuuuguucuuauugcccaggcuggagugcaauggcgccaucucggcucauugcaaucucugccucccggguucaagcaauucuccugucuca

SEQ ID NO: 2252688 - RNA, 83 nt, Homo sapiens
gucaaaaaucaguuaacuguagauacauggauuaauuucuggguuaucuauucuguuccauuugucuauguuucuguuuuggc

SEQ ID NO: 2252689 - RNA, 89 nt, Homo sapiens
gacuuuuaugauagcuugaauguuuacuuuguuuaauacaugagcauguaguagacaguagguuaauauccacauguaguaugaaaguu

SEQ ID NO: 2252690 - RNA, 57 nt, Homo sapiens
uuuccaacguaugguuucaagcuaccgugauaaagccacugaauacagcguugggaa

SEQ ID NO: 2252691 - RNA, 116 nt, Homo sapiens
ucaguuacauauauaucaggccaugagauauuguuuguaaguccuuaaguucggauuuuaaaaaucauuuucuuucuguucuuaaggccagauaauuucuauguaucuguaacuga

SEQ ID NO: 2252692 - RNA, 65 nt, Homo sapiens
aucuucaagguuaaaguucgccugugagcauacaccuguaaucacagagguuuggccucaaaggu

SEQ ID NO: 2252693 - RNA, 102 nt, Homo sapiens
cagauuugcuacacggguaaauugcaugcugcggggguuuaguguacagaugauauugucacccgggcaguaagcauaguacccaauagguaguguuuucug

SEQ ID NO: 2252694 - RNA, 63 nt, Homo sapiens
cuacauuuuaugcuugugugaauuuucccaguacuugggaaacacacuggcacaaguaggugg

SEQ ID NO: 2252695 - RNA, 98 nt, Homo sapiens
cuuacugcuugcugauauuuauguaaaaagcccagccgcugagagggccacgauauugccaauuucagcucuacuuuuugcauuuaguaagauaaaag

SEQ ID NO: 2252696 - RNA, 84 nt, Homo sapiens
uggcuuuggucuuaccaguggugcuguaaacuuuuaacuauuuucugaaguuuacaaaggcaauuugguucauauauuaaguca

SEQ ID NO: 2252697 - RNA, 87 nt, Homo sapiens
uggcaauuaaauauaacacuuuaauccaccuuaagaaucugaaagagauucucuguggaauggaaugauuguguaugaaucaugcca

SEQ ID NO: 2252698 - RNA, 99 nt, Homo sapiens
auaauacaugcuagaugaacaguuauagguuugauuuuuaaaugauuggcauccaguuacacguaauaguaagccuggcuaucauuuaaugaguguuau

SEQ ID NO: 2252699 - RNA, 70 nt, Homo sapiens
cugacccauguaagugugcucaaauguuauuaauaauguugaauaaugcccugaaacacugcugggucag

SEQ ID NO: 2252700 - RNA, 97 nt, Homo sapiens
aacaaccccucggggugauuauaagcucauuccagccauguccauuauguguggaaucugggucuaugagcuugaauuucaacuucgggcuauuguu

SEQ ID NO: 2252701 - RNA, 64 nt, Homo sapiens
uucgguuugccaguauuuuacugaggauuuucgcaucgauguucaucagggauauuggccugaa

SEQ ID NO: 2252702 - RNA, 64 nt, Homo sapiens
aagaggcagaaauaucgcugaauggugaaaaacagcucccccauauucagcagugucugcucuu

SEQ ID NO: 2252703 - RNA, 65 nt, Homo sapiens
ucauugcuaaaagucauauauaauugugugaauauaccacaguuuguuugaaccuuggcaauuga

SEQ ID NO: 2252704 - RNA, 80 nt, Homo sapiens
uuagguaggugcaaaaguaauagcgguuuuuaccauuauguucaauggcauaaaccaccauuacuuuugcaccaaccuaa

SEQ ID NO: 2252705 - RNA, 55 nt, Homo sapiens
uuugaaaguaauuugguuggugcaauuacuuuugcgccaaccaaauacuuucaaa

SEQ ID NO: 2252706 - RNA, 61 nt, Homo sapiens
augauuagagagcuggguguccuuugacuugugaaaagucuuaggagguuucuuuaauuau

SEQ ID NO: 2252707 - RNA, 66 nt, Homo sapiens
ucucucacuacuccuauucaacauaguacuggaaguccuagcuaaugcagucaggagaaggaaaga

SEQ ID NO: 2252708 - RNA, 81 nt, Homo sapiens
aucagugcaauacaucguaucaacagaaugaaacauaaaaaucauaugaccauuucaauugauauggaaaaagcaugugau

SEQ ID NO: 2252709 - RNA, 77 nt, Homo sapiens
gagaguuuugaucauaaagggaugcuagauuuuuucaaaugcuuuucugugucuacugagaugaucauguuauuuuu

SEQ ID NO: 2252710 - RNA, 55 nt, Homo sapiens
uaacuuugcuuggugacucagagguuuuuacaccccuggaucaucaguaaaguua

SEQ ID NO: 2252711 - RNA, 70 nt, Homo sapiens
caguuugucuugccaaugccauuugauuugcggggacauggugugucuuugaguggagcgaggcagauug

SEQ ID NO: 2252712 - RNA, 56 nt, Homo sapiens
cagaacuauuuuuuguguaaaguugagauggccuuugugcaaaguugugguuucug

SEQ ID NO: 2252713 - RNA, 98 nt, Homo sapiens
ucucaaggcuacucugaagucuuugucuccuaagacucuguggagacaaagacuucaccagagagucuuaggagacauagacuuaucauguaaggaga

SEQ ID NO: 2252714 - RNA, 87 nt, Homo sapiens
uguuuagugacucuguguguaauaccuuugacuauauguggagaaccaugaaugaaguugguuguuugcucauaaguucacuggaca

SEQ ID NO: 2252715 - RNA, 75 nt, Homo sapiens
ugcuuuugcugcacaguucuuaagauuauuuccuuugucugacuuuagguaacuugaugacuguguaccugggug

SEQ ID NO: 2252716 - RNA, 63 nt, Homo sapiens
augagauuuggguggggacagagagccaaaccucauucagccucuggcccccucaaaucucau

SEQ ID NO: 2252717 - RNA, 59 nt, Homo sapiens
aggauuugacuuaaaguuauaugacuuaaaaaauguauauagcuuaaaguuuagauccu

SEQ ID NO: 2252718 - RNA, 121 nt, Homo sapiens
ggguugccugagacuuucucgguauuauuauguuggugcaaagguaauugagguuuucgccauuacuuuuaauaccuuugcaccaaccuaauagcaaugaaagucccacaucucaggaccc

SEQ ID NO: 2252719 - RNA, 70 nt, Homo sapiens
uaucacauguuuucacuuccaugugggagcuuaaaaaguuaaucucauggagguagagaguaaaaugaua

SEQ ID NO: 2252720 - RNA, 84 nt, Homo sapiens
acuacuggguauguagcuaauggaaaggaaaucaguauaucaaagggauaucugcaucccauuuuuaucagcacuauucauggu

SEQ ID NO: 2252721 - RNA, 73 nt, Homo sapiens
uaaguuaauguuuaagacuccuauuacuaauaauaauugaaacaguaauaggaguaguaguagcauuaauuua

SEQ ID NO: 2252722 - RNA, 86 nt, Homo sapiens
uauuagguuggugcaacaguaauugcgguuuuggcuauuuaaaaguaauggcaaaaaaccgcaguugccuuugcaccaaacuaaua

SEQ ID NO: 2252723 - RNA, 79 nt, Homo sapiens
agaucaaagagagcuaugugcauaauuaucauaaaauauauggauguuuaaaaauguauguaaagcucucuaaaaaucu

SEQ ID NO: 2252724 - RNA, 93 nt, Homo sapiens
gacaccaccccauggagggauugaggguccugauaagaguggaggucuaggcuccccuucaccuggguuggccaucauuuuuucugugguguu

SEQ ID NO: 2252725 - RNA, 113 nt, Homo sapiens
uucuuuucuucuugaggucccaaaauaucuugagguuccuggaccugcuagaaagugucauucuuuauuuaucacaggucaggaaucuugcaagggaaccauaagacaaggaa

SEQ ID NO: 2252726 - RNA, 91 nt, Homo sapiens
aggcaugcaauguguaauacagcaggguaaauggaguauucaucaccucaagcauuuacccuuugcauuaccaacaauccaaucauagccu

SEQ ID NO: 2252727 - RNA, 78 nt, Homo sapiens
gguaucuuuauagcagcaccccacuaccucagugccaauucaguguauuagucaguucucaugcugcuauaaggaacu

SEQ ID NO: 2252728 - RNA, 57 nt, Homo sapiens
gcccaggaggagaggcuguggugagccgauaucgugccauugcccuccagccugggc

SEQ ID NO: 2252729 - RNA, 79 nt, Homo sapiens
aaguaaaagaauacugucuauucaugguauacuaugcaaagagcuucuaugcacaggaauggauggauauuuuauacuu

SEQ ID NO: 2252730 - RNA, 76 nt, Homo sapiens
aaaugucacagacuccauugaagguaauagguuuagaucaccauuacacuuucuauucaaugagcugaggcuguuu

SEQ ID NO: 2252731 - RNA, 65 nt, Homo sapiens
uuuguccacuguugugucuucagugccugccauagagcaggcaugaaauacaugcauugaauaaa

SEQ ID NO: 2252732 - RNA, 83 nt, Homo sapiens
ggucuggugggagguuacuggaucauggggucagauuucccccuuguuguuuucaugauacugaguugaguucucacaagauc

SEQ ID NO: 2252733 - RNA, 67 nt, Homo sapiens
aaugucuuaucauuucuucuaguuuuucugaggaugucagauuauuggguuaaaggauaugaacauu

SEQ ID NO: 2252734 - RNA, 57 nt, Homo sapiens
gucauggagggacauaacuaacuucuguuuaggcuuugaguguggggucuccaugac

SEQ ID NO: 2252735 - RNA, 104 nt, Homo sapiens
cucugccccuagcaacaacuuuggaguuccaaagacccuagcauuacuuuuaaauacagucaucucucagggugguggacucuaauagcuguugagguacaggg

SEQ ID NO: 2252736 - RNA, 85 nt, Homo sapiens
aaauuagcugggugaggugaugcaugccuguagucccagcuacucagaaggcuaaggcaggagcauugcuugagcccaggaguuu

SEQ ID NO: 2252737 - RNA, 66 nt, Homo sapiens
uaaaacaaugaacaucauuuauaguucauuaccaagaugaacuaugugggauguuuuacuguuuug

SEQ ID NO: 2252738 - RNA, 59 nt, Homo sapiens
uuggcaaacacuacaaaccagaauuuuuuucagauagcugguuguuacaugcuugccag

SEQ ID NO: 2252739 - RNA, 70 nt, Homo sapiens
gagaccuucacaguagccccucccaucauaggccuggaggccuaggagggagaaaugguuuuguggucuc

SEQ ID NO: 2252740 - RNA, 61 nt, Homo sapiens
guugaaucauuucuugucuucaguuuucucagaagaacugaaacaaugagagauacauaac

SEQ ID NO: 2252741 - RNA, 89 nt, Homo sapiens
gaagacccggcuuucuccaggugucauccaccuccuguccugcugcccuguccagggggggcaccuuggugaagaggccggucaucuuc

SEQ ID NO: 2252742 - RNA, 63 nt, Homo sapiens
gagggcacugcuuuccuuucaaaauguaggguucaaauccgaugaagggguggcagugugcuu

SEQ ID NO: 2252743 - RNA, 94 nt, Homo sapiens
cccucaggugauucauaaguccaugaagucuuguggguuagaaccacuaacccacaagcccuugucaugggaugcagcaugauccaccuggggg

SEQ ID NO: 2252744 - RNA, 57 nt, Homo sapiens
gggaucccaagaugagcagggccucgaaaucuccagucaguaugcuccuuggauccc

SEQ ID NO: 2252745 - RNA, 60 nt, Homo sapiens
ugugaauagugcugcgauaaacauaugugugcaugugucuuuauagcagcaugauuuaua

SEQ ID NO: 2252746 - RNA, 57 nt, Homo sapiens
auucuagcacuuugggagacugaggcagaaggguugcuugagucuaggaguuagaau

SEQ ID NO: 2252747 - RNA, 73 nt, Homo sapiens
cugaauucucuguauauuuaagaucccuacuuugcuagcuuuauuguaugggauaguaucaguggaauaucag

SEQ ID NO: 2252748 - RNA, 70 nt, Homo sapiens
aguuuagagaaauggcauuuuauuuccuaguuuuuuaaguaggaaauguuggucccauuucuuauagacu

SEQ ID NO: 2252749 - RNA, 63 nt, Homo sapiens
gucugucauggauucugagucugggcguccgcuguugcccaggcuggagugccguggcuggau

SEQ ID NO: 2252750 - RNA, 108 nt, Homo sapiens
agauuaagccuucuggagaccugaugugagcuuuuuaacuuuagauguuuuuuauaugccuaaggcccgugaguuucauaucucgguuuccacaaagagcuuggaucu

SEQ ID NO: 2252751 - RNA, 76 nt, Homo sapiens
gcaguagguguguggugggagagcaaguaaagcuucaccuguguuuacagcugcuccccaucacucgcauuaccgc

SEQ ID NO: 2252752 - RNA, 56 nt, Homo sapiens
ucuugcagagucauucuaauuucuaguuauucuucuaggaagagucccucucaaga

SEQ ID NO: 2252753 - RNA, 55 nt, Homo sapiens
uaagagagucuguugaucuguaucuucuccaauugcaguacugucagacuucuua

SEQ ID NO: 2252754 - RNA, 77 nt, Homo sapiens
ggcagaggaagcagcuggccugagcgguggcgggugagggcaacacgcugucacugggaggggcagcagucccugcu

SEQ ID NO: 2252755 - RNA, 61 nt, Homo sapiens
ucugcaaaauauaagccagauuaagcaaauuccugaguaguacuggcauguauuucccaga

SEQ ID NO: 2252756 - RNA, 56 nt, Homo sapiens
uagaucacucaggcaauaaaaguucugucaucgaacuccugaccucaagugaucua

SEQ ID NO: 2252757 - RNA, 98 nt, Homo sapiens
gucaagagguuuucuuacuuuuuguuuguuugauaugggauaaaugagcauguucauaugcugaugggaauaaaccaguaagagaauaaaauguugac

SEQ ID NO: 2252758 - RNA, 76 nt, Homo sapiens
gguuuuuguuguugguucuguuuauaugcuggauuacauuuauugauuugcauauguugaaccagccuugcauccc

SEQ ID NO: 2252759 - RNA, 130 nt, Homo sapiens
ucuugggcaagucucugaagguaucuggccagagcguccuccuuuacaguuggacucacgagggcccuuggcaacuccauaguccucugaguccauguagaagugcuuuggaaagagacagggcugaaga

SEQ ID NO: 2252760 - RNA, 57 nt, Homo sapiens
cucaccucgugaucugcccacuucggccucccaaagugcucggauuacaggcaugag

SEQ ID NO: 2252761 - RNA, 98 nt, Homo sapiens
uaagaaucuguuaauaaaggcuaucaguggaacuaggugaaugguaaguguauuuauauguuagacauggugggucuuuauuacugugcucuuucuug

SEQ ID NO: 2252762 - RNA, 60 nt, Homo sapiens
gcggguggguuugggauaggguggugaggacaguaaguacccugcuaaacagcccccugc

SEQ ID NO: 2252763 - RNA, 93 nt, Homo sapiens
cuccccauucccugagagcagggucuuucucucccucucugaagacuaagccagaguaaugagacucaccuuugcucugcaguaggugaggag

SEQ ID NO: 2252764 - RNA, 108 nt, Homo sapiens
ggcuccauaaccagugaaggaugaugaaaugguuuuacugcaaaaugggaggggguucccccacugcugucucccaagguuaaaccccuuacucauccaggaggagcc

SEQ ID NO: 2252765 - RNA, 70 nt, Homo sapiens
gccuggccuaagcccaggaaugcacuucagcuccugguugagcaaugucacugaggcuugggagucgggu

SEQ ID NO: 2252766 - RNA, 70 nt, Homo sapiens
gaugugggcagcagcugcucugucccacaugcaaacucuccagcagguuaagacagcugcagcccacauc

SEQ ID NO: 2252767 - RNA, 82 nt, Homo sapiens
gggggaagaggcauugaagauauggaagucugauucuuuuaccaucuacucagagcuuuuucacuucucugugcccaccccc

SEQ ID NO: 2252768 - RNA, 63 nt, Homo sapiens
cagcaucuaagugaguuauugacugaauaugaaaugaucagauugaugcauacuuaaauguug

SEQ ID NO: 2252769 - RNA, 67 nt, Homo sapiens
agugaugcagauggaguuaguuucuaacaugugaacgugagaacuguuuugguuuggguccaucauu

SEQ ID NO: 2252770 - RNA, 66 nt, Homo sapiens
gguaaauugugucuuguagagagauauuugauaguaaauuacauguuuuuaaaaagacaauuugcu

SEQ ID NO: 2252771 - RNA, 70 nt, Homo sapiens
uggacagcaucccauucacagucacccuucuccauggaguggccauuggaaggugcacugugacagucca

SEQ ID NO: 2252772 - RNA, 58 nt, Homo sapiens
auuuaggcuuaagagcacuaggucuugcacagcuaggugcauugucuugaguuuaaau

SEQ ID NO: 2252773 - RNA, 73 nt, Homo sapiens
aucugucugguuggagaaucacugcaagccaaggcguggcauuggccaauggugauucccggccuccucaggu

SEQ ID NO: 2252774 - RNA, 64 nt, Homo sapiens
uauagauauauauaggugauuguauguacacacuauauauagcacaucuguguguacauuugug

SEQ ID NO: 2252775 - RNA, 60 nt, Homo sapiens
uugaaagacagaggggcaaguuggauuaaaaagcgagacccaacuguaugcugucuucaa

SEQ ID NO: 2252776 - RNA, 58 nt, Homo sapiens
ugcuguuuucccauagcuggucauucucuguuuggcugaaugcuaaaggaaaacagua

SEQ ID NO: 2252777 - RNA, 79 nt, Homo sapiens
cagcagcuugacaaguuguccaguaugagugaaaaauacauuucuacuguucggacuugcucauuaaaucccacugcug

SEQ ID NO: 2252778 - RNA, 83 nt, Homo sapiens
cagcucgacagggagaguuuacuguuacauuuaaauaaaaauuucucuuugaauuugucaccucucucccuuuuagacggcug

SEQ ID NO: 2252779 - RNA, 81 nt, Homo sapiens
cugagugguauguuuauaaguauaggagaagcugguauuccccuaauuguuacuaucuaauaaacuacccccaaaacuuag

SEQ ID NO: 2252780 - RNA, 71 nt, Homo sapiens
auggggcuguuauggcugaggggcugaauuucuaauuuuaaccaauuucaguuuagguguaacggccacau

SEQ ID NO: 2252781 - RNA, 60 nt, Homo sapiens
uauauucuggcuauagcaaaguaguuuaguugugaauauuauuugcauagugagaauaua

SEQ ID NO: 2252782 - RNA, 55 nt, Homo sapiens
uuucuuuuuauuucuguuguccacaaguuugugucuagcagcagacagagggagg

SEQ ID NO: 2252783 - RNA, 71 nt, Homo sapiens
uaauuuucccacuugguagauugguagcccaccaaagaaggggcuguuaacauuuuagagugggaaaauua

SEQ ID NO: 2252784 - RNA, 62 nt, Homo sapiens
uggaaucuuaggugaaggcuuuaaaaaauacaagugcucaggccucaccccuugagaaucua

SEQ ID NO: 2252785 - RNA, 78 nt, Homo sapiens
gggggaaaauacauauuuuguuuacauuaaauuuugaagugauuuaggcuuuauugaaaacaauacuggccuucccuc

SEQ ID NO: 2252786 - RNA, 84 nt, Homo sapiens
gaucagcuggaucccuggcaggggcuggggcuggugcuggggcugggugcugagguagcuccaucuucagggguucaguggguc

SEQ ID NO: 2252787 - RNA, 109 nt, Homo sapiens
gggagcucccagggcucagcaaauuguccuacugguuugagucauaaggauaacuaaaacggguaccaagcucaaauaggagauuugugaaagaucaagggaaccuccc

SEQ ID NO: 2252788 - RNA, 68 nt, Homo sapiens
ugugaacacaucugguuaguugaugaaacuguuuucacaguacaucuggcuggauagauacaaccaca

SEQ ID NO: 2252789 - RNA, 57 nt, Homo sapiens
auaugccacugaacuguacccaucaaaaugguuaagaugguacacuuuauggcaugu

SEQ ID NO: 2252790 - RNA, 88 nt, Homo sapiens
uuuauauauauagcucuugcuuacccacugugcuauuccugauuagauugcgggcuuacagaguugguaaaggaguugacaaaauaaa

SEQ ID NO: 2252791 - RNA, 60 nt, Homo sapiens
acugagucuuaggguaccaaacugacuugccucauauauguggaaucugaagaucucagu

SEQ ID NO: 2252792 - RNA, 63 nt, Homo sapiens
gcauuuauguugauuccaugucuuugcuauugugaauagugcugugauuaacauaauguaugc

SEQ ID NO: 2252793 - RNA, 60 nt, Homo sapiens
gguggaaccauauggaauugccaauacuuugacguacaaaaauggcaauaugguucuacc

SEQ ID NO: 2252794 - RNA, 81 nt, Homo sapiens
aucguuaaggcuucuuuggcacuuccuaagugccagggacuguuguuaaugccuuugaagugcuaauaaugacuuaauggu

SEQ ID NO: 2252795 - RNA, 80 nt, Homo sapiens
aagaucacuuuuauuaccuagggcauuagucucaaaccauuauuaacuagaucacauauugccuuuguaguaggugucuu

SEQ ID NO: 2252796 - RNA, 60 nt, Homo sapiens
gcuccaauucaaagguggguaggcuugagacccaggaagaccugauguuucaguuggagu

SEQ ID NO: 2252797 - RNA, 72 nt, Homo sapiens
gggaagugaacagaccuauuucaaucauuuaguagugacaaagcugagugugaaaucuagguuucuuguccc

SEQ ID NO: 2252798 - RNA, 77 nt, Homo sapiens
ucgcuugaacccgggagcuggagguugcagugagccaagauugugcuauugcacuccagccuuggcaacaagaguga

SEQ ID NO: 2252799 - RNA, 58 nt, Homo sapiens
ugagcugaggucucauucuguuucccaguuuggagugcaguagugcgaucucagcuca

SEQ ID NO: 2252800 - RNA, 69 nt, Homo sapiens
acaauacugccuuuagcaaaacagugagaaauaaucuguaagcuuuacuauuugaacaggcaguguugu

SEQ ID NO: 2252801 - RNA, 78 nt, Homo sapiens
cauagcagauaacauuugucgagcacugacaacaugcuagacauuguguuaaguacuuuacagacauuaucuugcaug

SEQ ID NO: 2252802 - RNA, 80 nt, Homo sapiens
cuuuugagaagcuugaccugcagauucuuacaguccaaguuuugcugugguuugugaauggaguagcaggaucacagaag

SEQ ID NO: 2252803 - RNA, 73 nt, Homo sapiens
aucuuuuauugcugaaaaugcuaaugaucaccugagccuucagggagucuuagucuuuuugcuggugaagggu

SEQ ID NO: 2252804 - RNA, 62 nt, Homo sapiens
ugagaaugaugauuuccaauuucauccaugucccuacaaaggacaugaagucaucacuuuua

SEQ ID NO: 2252805 - RNA, 101 nt, Homo sapiens
cacaguugagcacuuuuagacacuagcugcaaagggagagaugauugauucauuauuaaucucuuccaaccuuugucuauggcgggaacgugcuaccugug

SEQ ID NO: 2252806 - RNA, 72 nt, Homo sapiens
ugaaagcaugcuccaaggcauauggaauagggaagaguuaacccuaauuauugcauuggagaauguuucuca

SEQ ID NO: 2252807 - RNA, 62 nt, Homo sapiens
cugguguuugagaagcugaugucaggacaugauggagcuuggcugcagcauccgaggaccag

SEQ ID NO: 2252808 - RNA, 59 nt, Homo sapiens
uuuggcguguuauaguuggguuggguggcugugccucucccugaacaugacacaccaga

SEQ ID NO: 2252809 - RNA, 66 nt, Homo sapiens
caugagaugugggggugucagggucagaguaauaugguuuggcuguguuucccuacaaaucucaug

SEQ ID NO: 2252810 - RNA, 76 nt, Homo sapiens
gaguuguuuucuacaguguauuuauggagggugcaagugccuuuugacaguucuauuguguauuguaaaaaaacuu

SEQ ID NO: 2252811 - RNA, 61 nt, Homo sapiens
cugaagcauggacuauggugaugauuauuuuaaguaacaaagcuagggaauccaucuucag

SEQ ID NO: 2252812 - RNA, 59 nt, Homo sapiens
cuuucuaagaccuuccuacuuuucuaagaagaggaaguagcuacugucuuucuggaaag

SEQ ID NO: 2252813 - RNA, 78 nt, Homo sapiens
gagcuggugccuuccaguggacuacuucauccuagaagcccucgggaugcacguuucacuggaagaaaggccuagcuu

SEQ ID NO: 2252814 - RNA, 85 nt, Homo sapiens
gaauuggaauucugguaauugcaccagguuucucaggguucgguucccccuagaaacacagguggaauugcuucaguuuguauuc

SEQ ID NO: 2252815 - RNA, 70 nt, Homo sapiens
guccacuuguagaguaauugagaggaugaagcaagaugaugcauaucaaguacuuugcauagugccgggc

SEQ ID NO: 2252816 - RNA, 70 nt, Homo sapiens
uggaugauuggcaagagaacaacaucucuccuuugguagaacggacaguaaucucuuuugccuauuucua

SEQ ID NO: 2252817 - RNA, 90 nt, Homo sapiens
ggaguuucacucuugucacccaaggcuggagugcaauggugugaucucggcucauugcaacuuccgccuccuggguucaagcgauucucc

SEQ ID NO: 2252818 - RNA, 64 nt, Homo sapiens
accauauaccuaggcuacaugguuuggacuauugcuucuaagcuacggaccuaggcuacauggu

SEQ ID NO: 2252819 - RNA, 107 nt, Homo sapiens
uuuguuugugucaagaccuuuuauuguagagauccuucacuaggggcaucuuguaugauuaaaucugaucgucugugguaagaucuuuaagauccugacuaaauaaa

SEQ ID NO: 2252820 - RNA, 76 nt, Homo sapiens
aaaagucucuaaguuguuggaguuccauuguucuaaaauaauuaggaacuguggaccuaauaauuuaaaagcuuuu

SEQ ID NO: 2252821 - RNA, 68 nt, Homo sapiens
guguaucuuacagaguucuaucuaaaaugcccuacccaggcucagagaugcauucuuguaggauauau

SEQ ID NO: 2252822 - RNA, 83 nt, Homo sapiens
gauacuaacagauaugccagggagaauuguucaaguaacaugauaaugauuuuggggaaagucccugaguuucugugaauauc

SEQ ID NO: 2252823 - RNA, 71 nt, Homo sapiens
aggcccuugcucaaaacagaaaauugucaucuuauaugucuuauuacauuuuccuguagggggcaaggccu

SEQ ID NO: 2252824 - RNA, 130 nt, Homo sapiens
accgcgcccggccaagcuuacuuuuuaagaacuggcauagggcgggcacaguggcucacgccuguaaucccagcuacugugcccggccuaugccaguucuuaaaaaguaagcucaggggcugggugcggu

SEQ ID NO: 2252825 - RNA, 64 nt, Homo sapiens
uucaguuugccaguauuuuauugaggacuuuugcaucaauauucuucagucauauuggccugga

SEQ ID NO: 2252826 - RNA, 60 nt, Homo sapiens
cugagcuuguuuuccugcaacuagauggucccaucugggggugaugggagacagugacag

SEQ ID NO: 2252827 - RNA, 67 nt, Homo sapiens
gccuguauccgugcucucuaauaguguccacuaaccacacguggcuauugagcacaugaaacauggc

SEQ ID NO: 2252828 - RNA, 85 nt, Homo sapiens
uauuauagcaacagaaagacaacauaggaguaaauguaacaagaaauguuacaguggugaccuuguauugcaguguuguguagug

SEQ ID NO: 2252829 - RNA, 86 nt, Homo sapiens
agucagagaggagcugagagaugacugauguugaggucaagucauccuucuguucucacagccauuucucccucucuuuccugacu

SEQ ID NO: 2252830 - RNA, 62 nt, Homo sapiens
ugcagugugcuggggucuccauggcuguguuuuuaaaaucagaucagacaccagcgcacgca

SEQ ID NO: 2252831 - RNA, 89 nt, Homo sapiens
ggacugaggacuccagacaaauagacucauuuuuaucgagcaugaucauaauuaugccugauaaaaaugagugcuagagacuuaggucc

SEQ ID NO: 2252832 - RNA, 78 nt, Homo sapiens
ucaccaggucaaaugccaacuuauggcuaugcacagugguuacaauugugagcuauggaguuguagaggucuggauga

SEQ ID NO: 2252833 - RNA, 88 nt, Homo sapiens
gugagucacaguggaagaacugguuuccaggaguauagauguguuguggaauuuggcccugcugaccauucccucauugcugaagcac

SEQ ID NO: 2252834 - RNA, 96 nt, Homo sapiens
caguagggucacuuagcuguaguguggaacucaauacaacgcaugcuccguucagcuguuuugucgagcuuuucagaaaacagcaugaccuuacug

SEQ ID NO: 2252835 - RNA, 88 nt, Homo sapiens
ggagaauugcuugaaccugggaggcaaagguugcagugagccgagaucaugccacugcacuccagcccgggugacacagugagacucc

SEQ ID NO: 2252836 - RNA, 77 nt, Homo sapiens
gucccaaauuggaaugggauuugaagucuggcagcacaugaagguagaugaccagauucccauuccgacagugggau

SEQ ID NO: 2252837 - RNA, 58 nt, Homo sapiens
gucucgagucucaccuauaucuaauuuagauauuuagaugagauguuagacuuuagac

SEQ ID NO: 2252838 - RNA, 119 nt, Homo sapiens
aaauguagacaugcuaagagcaggaauuaaacucaaguuucuuaaugucagaucugauacucuugacacuugcccuuagaaacauguaguugauuauuuuuguuuuucauguuauauuu

SEQ ID NO: 2252839 - RNA, 64 nt, Homo sapiens
uuguuguuuuguuuucugagaaugggucuuacucuggauccuagguuagagaacaaaaccauga

SEQ ID NO: 2252840 - RNA, 88 nt, Homo sapiens
gaaauauuuuguaacaaucuccaggugauaccacauuuaucucuucaaaaugaggugauaucuggaaauuaaaugagcaaaccauuuc

SEQ ID NO: 2252841 - RNA, 109 nt, Homo sapiens
gggagacacuauggcuccugauggcagcggcuguuccccuggucuauagcaggcuauagaugaggguggccagcuggacagcagugaggagcaaagugaaaaucauccc

SEQ ID NO: 2252842 - RNA, 71 nt, Homo sapiens
guaaauggauauugccaucuccuuuuaaaauuaugcauuuaggaaagaauaggagaggcaguuuccuuugc

SEQ ID NO: 2252843 - RNA, 64 nt, Homo sapiens
auugugaauagugcugcaauaaacauacgugugcaugugucuuuauagcagcaugauuuguagu

SEQ ID NO: 2252844 - RNA, 89 nt, Homo sapiens
ggagaaucgcuugaacccggggggcagagguugcagugagccaugaucgcucuauugcacuccagccugggugacaagagugaaacucc

SEQ ID NO: 2252845 - RNA, 71 nt, Homo sapiens
uggguauaggugaugaggaaggagaauucaaagacgaauuuugaauguuugcagcuuauaccauauaccca

SEQ ID NO: 2252846 - RNA, 89 nt, Homo sapiens
ggagaaucacuugaacccaggaggaggagguugcagugagcagagaucaugccauugcacuccaucuugggcaacaagagugaaacucc

SEQ ID NO: 2252847 - RNA, 66 nt, Homo sapiens
ccuagcuggaguuuuuguuauaggauauuguguggcagagccugggacaugagcucgagaccuggg

SEQ ID NO: 2252848 - RNA, 57 nt, Homo sapiens
ggcaggucaucgauucauaaacacugagaguguuuucaugugauaguugaaccugcc

SEQ ID NO: 2252849 - RNA, 85 nt, Homo sapiens
uuuacaaauguugcugacaggccagauuuagcccaugagcucuaguuugcugauaacugaucuggauuuguaaaucauauguaaa

SEQ ID NO: 2252850 - RNA, 72 nt, Homo sapiens
ugucuuuaucagcagcaugaaacuggacuacuaugaaagugaucuuccauuuuccugcuuuugacugagaua

SEQ ID NO: 2252851 - RNA, 62 nt, Homo sapiens
ggguaggaggugggcuguccugugcauugcagaauguuuagcagcaucucuggcuucuaccu

SEQ ID NO: 2252852 - RNA, 76 nt, Homo sapiens
auacuauuggcaugguugucgcuugugggaauguaagcaauacauuccacauguaggacaauuuugaaagaaguau

SEQ ID NO: 2252853 - RNA, 59 nt, Homo sapiens
ugagauggaguuucacuuuuguuguccaggcuggagugcaauggugugaucuccgcuca

SEQ ID NO: 2252854 - RNA, 59 nt, Homo sapiens
cgaguaucuuacccugcugguaaguggcaccaccgcauacaucagccugaaagagcucg

SEQ ID NO: 2252855 - RNA, 73 nt, Homo sapiens
augagagcaacaccuucacuugaaaacugguaagaguuuggugauaguguguugggggagguauuguuuucau

SEQ ID NO: 2252856 - RNA, 58 nt, Homo sapiens
ugcuucaguaguaaauuguuauugaagcuucagucaauagcaaauugcuauuaaggca

SEQ ID NO: 2252857 - RNA, 65 nt, Homo sapiens
ucucugaggaagaggcuguaauuugcaugcuuaaucucaugucuauuccacuuuuccuucaggga

SEQ ID NO: 2252858 - RNA, 60 nt, Homo sapiens
uucugcuagucugucagaucuuagccuuagcaguuacuucuucugacauauuagugagga

SEQ ID NO: 2252859 - RNA, 81 nt, Homo sapiens
augcuuuaaaauuuguguaucuuucuagggcaaaagagggugugcuucuguccuggugaugcccaaauucuaugauagcau

SEQ ID NO: 2252860 - RNA, 76 nt, Homo sapiens
uaucuuggugaauauuuuauguaagcuugagaagaauguguguucugcuguuguuugaugaaguaaucuauagaua

SEQ ID NO: 2252861 - RNA, 100 nt, Homo sapiens
gaggcaggagaauugcuugaacccgggaggcggagguugcagugagucgagauugcaccauugcacuccagccuuggcaauaaaagcaaaagucugucuc

SEQ ID NO: 2252862 - RNA, 72 nt, Homo sapiens
auuaaugaggcaggaaaggcguaucugggaaauaaaaucaucaucuaagcauggcuuuucuucuuuguuaau

SEQ ID NO: 2252863 - RNA, 111 nt, Homo sapiens
gagccugccugaucaucuucacugucaccuugcucauccucggaggaugaggacuuuucaucugaggaacuggcaaagauggcccugaauaaguccauggaugggcggcuc

SEQ ID NO: 2252864 - RNA, 73 nt, Homo sapiens
uguucucauuguccaacuucuuucaguuagcuguauaaauuguaacugauuaagucugggacaugaguugaca

SEQ ID NO: 2252865 - RNA, 55 nt, Homo sapiens
aguagagguaggucuucgagucucagggacaucccuggccugcccaaugucugcu

SEQ ID NO: 2252866 - RNA, 89 nt, Homo sapiens
ggagggcugccuggcuggcaucaggcauccucucugaguuugcaucugcuuaaggcagugucuaugccagucugccaagcagacucucc

SEQ ID NO: 2252867 - RNA, 73 nt, Homo sapiens
gggaccuaacauagugcuauggcagaccuugaggcugagucuucagaguccaguguggcacuauggugguccu

SEQ ID NO: 2252868 - RNA, 94 nt, Homo sapiens
gccaaucaacgcccuguagcuagcuagagguuuguaaaaugcaccaaucagcgcucuguggcuagcuacagguuuguaaaaugcgccaauuggu

SEQ ID NO: 2252869 - RNA, 77 nt, Homo sapiens
ucgcuugaaucugggaggcagagguugcagugagccgagaucgugccauugcacucuagccugagcagcaagaguga

SEQ ID NO: 2252870 - RNA, 89 nt, Homo sapiens
auuugaagacauagugcuguaauucuaaugaaagaugauaauuaacauaacccuuuaaugaaugaaugcagcacuuuuugauuuuaaau

SEQ ID NO: 2252871 - RNA, 77 nt, Homo sapiens
aaaggcuacuauacugaagcaaauuaacauguuuguaaucucacauaguuacugcuauaguuuggauauuugccuuu

SEQ ID NO: 2252872 - RNA, 63 nt, Homo sapiens
uuuggcauuagauaauuguguacuaaaaugggauaccacugcacaccuaucagaauguccaaa

SEQ ID NO: 2252873 - RNA, 69 nt, Homo sapiens
aaggaguggcaaaugaagauggagaggcuaggugggcaccggggcaaaguagccuuauuugcauuucuu

SEQ ID NO: 2252874 - RNA, 85 nt, Homo sapiens
gauguguuugacauaguuucugaaauagaccacagcauaugccacuugguuucuauuuuaagauagguauguugacagaggcauu

SEQ ID NO: 2252875 - RNA, 60 nt, Homo sapiens
gagacagggucuugcucuguuauccaagcuggauggauuacaguggcaugaucucugcuc

SEQ ID NO: 2252876 - RNA, 123 nt, Homo sapiens
aauaucacaggguguacacacaugggguacacccacugugauacuaggagcuguaucuuucgaagauauuacaaauaauaucccaguggauguaccccauguguguacacccacugugguauu

SEQ ID NO: 2252877 - RNA, 72 nt, Homo sapiens
uuccauggccaacauauugacuuuuuuguuaggaggguggaaucaccccuacuccauagucaauucauggga

SEQ ID NO: 2252878 - RNA, 57 nt, Homo sapiens
gggaggagagugaggaggauaauuuaaaacucauuaugcuuuggucauacuucuucc

SEQ ID NO: 2252879 - RNA, 60 nt, Homo sapiens
ugugaauggugcugcaaugaacauacacaggcaugugucuuuauaacagaaucauuuaua

SEQ ID NO: 2252880 - RNA, 58 nt, Homo sapiens
ugugcuuguaaaggccagagcagucuccuggaacguguuuuugcauuuaauaggcaca

SEQ ID NO: 2252881 - RNA, 58 nt, Homo sapiens
gggccucuggggauacagcagugaccaaaauacacaggucauugcccucauggggcuu

SEQ ID NO: 2252882 - RNA, 73 nt, Homo sapiens
aggcuggagugcaauggcgcgaucugggcucacugcagccuccgccucccagguucaagccauucuccugccu

SEQ ID NO: 2252883 - RNA, 96 nt, Homo sapiens
ccuuggaaccuccuaugugcugcaucuuuggauggaaauuggagucccagagacaaaugaggcuccacccugcuuccagaagcucagaguccaggg

SEQ ID NO: 2252884 - RNA, 109 nt, Homo sapiens
gagcaguuauacugugcugggagcucguuuuugccucugguugccuuggacucuccaaagcccaaaggcuagaaugacuaagucacccaaauagcaaagaugguggcuc

SEQ ID NO: 2252885 - RNA, 64 nt, Homo sapiens
ggcaacuccauuuccagagcagccccucugagccagggggcuauuccaggagaugcgaggugcu

SEQ ID NO: 2252886 - RNA, 68 nt, Homo sapiens
uagguuguucuauuaucuuacagcugggauaaagcaaucacaugcucuugugggaaaguagaaaccug

SEQ ID NO: 2252887 - RNA, 86 nt, Homo sapiens
ucugaauuggcuuuugaaagucugcgagaggcugggcaccauggcucacaccuguaauccuagcacuuugggaggccaaggccaga

SEQ ID NO: 2252888 - RNA, 94 nt, Homo sapiens
uuggaaaagcagaugguuuguauaacucacauugaaguuucuaaaauggcaaaaguucuauuggguuaucguucagcuguuugaaucuuucuaa

SEQ ID NO: 2252889 - RNA, 106 nt, Homo sapiens
ggcaugaagcuuuuaagucggcgcagcucaugcaccugcucaaugcagaucuugucuucuuguaccugagcccucugcugaguuaacugcuacaaagcuuccugcu

SEQ ID NO: 2252890 - RNA, 72 nt, Homo sapiens
uaggaaugugagauuuuauuaagcauaacaacucaaauguugauguccaguucauagaaacuccaucuccua

SEQ ID NO: 2252891 - RNA, 72 nt, Homo sapiens
uuuuuaucagcagcaugaaaacggacuacuacaguaaauugguaccaguaaaguggggugcugcuauaaaga

SEQ ID NO: 2252892 - RNA, 79 nt, Homo sapiens
ugauauuuuuugcaggcauuggaaguuuaggaaaucaauuuauucuuuuuaagcucuuuuuccuguaaaauugauauua

SEQ ID NO: 2252893 - RNA, 64 nt, Homo sapiens
uuagggaugagggagggaagcuagcccugacugccuugggucuggguucccugucuguccuuga

SEQ ID NO: 2252894 - RNA, 55 nt, Homo sapiens
augugaugguuaauuuuaugugucagcuugacugggccaugggguguccacauau

SEQ ID NO: 2252895 - RNA, 60 nt, Homo sapiens
ugcuuauuagccacauguggccagugguuacuauauugggcaguguggcugcauauagca

SEQ ID NO: 2252896 - RNA, 90 nt, Homo sapiens
uggcaauacugacgugauuggccaaacuaaagaacugcucaagccugugaaucagauuuaguaacuuggucaaaugguaagguauggcca

SEQ ID NO: 2252897 - RNA, 58 nt, Homo sapiens
ggggucuagaaacgggaccguucuuaacugacagcuugguacuguccuucuagauucc

SEQ ID NO: 2252898 - RNA, 65 nt, Homo sapiens
uugugugugugugguaagaguaccuaaggucuacucucuuggcaaaucaccaguacacaauacaa

SEQ ID NO: 2252899 - RNA, 55 nt, Homo sapiens
aggccacggugcuuuggaugcgggacuucucugccauccccugccauuguggucu

SEQ ID NO: 2252900 - RNA, 64 nt, Homo sapiens
guugugaauagugcugcaauaaacauaugugugcaugugucuuuauaguagcaugauuuauaau

SEQ ID NO: 2252901 - RNA, 102 nt, Homo sapiens
ugagauggagucucgcucuugucacccaggcuggagugcuguggcgcgauuccggcucauugcaaucucugccucccggguucaagugauucuccugccuca

SEQ ID NO: 2252902 - RNA, 105 nt, Homo sapiens
ggcuuagcuguuuuaagccacccucucuccauugcucuaaucagguugggauggguuuuuccugagacgaauggagugaacauggcgcuaggacagcugucgguc

SEQ ID NO: 2252903 - RNA, 61 nt, Homo sapiens
ugagaaugaugauugguaaaccccucguagguggccuuugguguugccaggcguuauuuca

SEQ ID NO: 2252904 - RNA, 89 nt, Homo sapiens
aaauaccuuucuagcuccauauaaagcaggaugccacagccuacauguauuaaaucaugcauuguauugaguugaauugaaugguauuu

SEQ ID NO: 2252905 - RNA, 60 nt, Homo sapiens
aaguggaauguuuguggcacaaagaaaggauacauucuugaggugacagauacuucacuu

SEQ ID NO: 2252906 - RNA, 85 nt, Homo sapiens
aaaaucagaugacuguacaugcauaguuuauuucugagcucucuguucuaguaaguaaacuaugcauguauggucaucugauuuu

SEQ ID NO: 2252907 - RNA, 93 nt, Homo sapiens
guguguuuguuugugugugagucuauucaauguaguuagaacuggguuuuaguuacuagucacagugaagaguucugaugacacagugacacc

SEQ ID NO: 2252908 - RNA, 127 nt, Homo sapiens
guaacauuugcagaauuaagacuauacaccuuuuggcauuguggauggaaucauuucaauugcagagcauuucagcuauaugggaguucuauucaucaugucuaacgguuaguucccauauguuuac

SEQ ID NO: 2252909 - RNA, 76 nt, Homo sapiens
augcuacauuggaaaauucuacuucaucugcuuugcuccuuguaaaugaggagguaugauuuucugaacuggguau

SEQ ID NO: 2252910 - RNA, 64 nt, Homo sapiens
aguuacacugaauugguuugccaacagcaauacugaagggcaagauagauaucagugucaaacu

SEQ ID NO: 2252911 - RNA, 78 nt, Homo sapiens
gaagagauuucuguaauauaagcuauggacauugaaaaggaucaagguuggccuggcacuaugugacaagguuuuuuc

SEQ ID NO: 2252912 - RNA, 68 nt, Homo sapiens
guuagcuaguagacaauuuuccugaaagcccugugcaaauauauucagagaaaaugggagcagcugau

SEQ ID NO: 2252913 - RNA, 91 nt, Homo sapiens
gcuuguauucuagaaaauccuguagacggaauuuacuuuugggcaaaaauaaagcagaacuggaauaugagacgggguugucaggacaggc

SEQ ID NO: 2252914 - RNA, 92 nt, Homo sapiens
uuguucuucuuuuggucuuuuuuccauuggauuugauaaacucuaucagacuuagucaaaucugaaggaaauuuccaaauuauggggaacaa

SEQ ID NO: 2252915 - RNA, 77 nt, Homo sapiens
gcuggggugggaguugggcccaagaccuuaggcagucccucuccuaaggcuuugcuggacucaguccacccaguagc

SEQ ID NO: 2252916 - RNA, 57 nt, Homo sapiens
uugcaugggagcugggugaggccugugacugcuggcuucuccccacuuuccugacaa

SEQ ID NO: 2252917 - RNA, 60 nt, Homo sapiens
gugcaacaucccuccauaauuugauagggcauauuuauauuaccaaggggaugucugcau

SEQ ID NO: 2252918 - RNA, 102 nt, Homo sapiens
aguaauaauuguaguguaauguuacagcauauuuugagauuauaaguuuuuuuaaguuuggaauuuuaaaauaggcaacuuugcuuuuauacauaaauuacu

SEQ ID NO: 2252919 - RNA, 56 nt, Homo sapiens
acuauggguuuuugucuguuuacucugugcagagcugagggguggggaccuauggu

SEQ ID NO: 2252920 - RNA, 65 nt, Homo sapiens
aggaagaacagauaauggacgcuggaagcccuuucuugccuggcaccgguuaaucuguuuuuucu

SEQ ID NO: 2252921 - RNA, 57 nt, Homo sapiens
ggggagcguauaggagcuuccagucucgcugagcugagcuaugccauauaugccccc

SEQ ID NO: 2252922 - RNA, 120 nt, Homo sapiens
gaaccucaaucagcuuuuuaaaaauacagauuccugggucccgucucuaauaugcuaagugagaggcuauuuagguagaacccagaaaucugaauuuuugaaagcuccccuugaugguuu

SEQ ID NO: 2252923 - RNA, 64 nt, Homo sapiens
guuaugaauagugcugcaauaaacauaugugugcaugugucuuuauaguagcaugauuuauaau

SEQ ID NO: 2252924 - RNA, 130 nt, Homo sapiens
acugcccaugagggcuguggugugagucugcuagccgugagagacagaugcauuacaaagggauggauuuagugcacucuuuccucucuuacugugaguagaugcugcacuucuugaaccuggugggagu

SEQ ID NO: 2252925 - RNA, 56 nt, Homo sapiens
gguuguccaguguuacacaggauuucuaaaauucuugguaaugggcugguauaacc

SEQ ID NO: 2252926 - RNA, 130 nt, Homo sapiens
uauguauacauagauacguguguguauguauacauagauacguguguauguauacauagauacguguguguguauguauacauagauacguguguguguguauguauacauagauacguguguguaugua

SEQ ID NO: 2252927 - RNA, 59 nt, Homo sapiens
acugccugggcaggguagaagucauuguugaagaugaggucuuucgguuaccaggcagu

SEQ ID NO: 2252928 - RNA, 79 nt, Homo sapiens
uuugaacaaguuuuccuuuacugaguaccaaaccauguaaugauaacuuggacuuuaauaaaagggaaaugaguucgaa

SEQ ID NO: 2252929 - RNA, 83 nt, Homo sapiens
augugggacugugguugaugauggugauaaagauacugaaacuuaugcuauucuuauugcuaaaucaugaccacacuuuacau

SEQ ID NO: 2252930 - RNA, 60 nt, Homo sapiens
auaccauguauguuucuccauuguuuggcaaaagacaugugugugcacauacaugugugu

SEQ ID NO: 2252931 - RNA, 115 nt, Homo sapiens
acacugaauuagcaaagacugaaccuugguacuuugagaaauaugagauuagguuccuguuagggucuagucacauuuucaucaaauaaucaauacauagccuuguuuuaggugu

SEQ ID NO: 2252932 - RNA, 101 nt, Homo sapiens
ugagaugggagaaucgcuugaaccugggagguggaguugcagugaccugagaucgugccauugcacuccagcuugggugacaagagugagacucugucuca

SEQ ID NO: 2252933 - RNA, 56 nt, Homo sapiens
uguauguguuuuauguguguuuaaauaaauauguuagauacacguguauacauaca

SEQ ID NO: 2252934 - RNA, 70 nt, Homo sapiens
ggaaacugagguuacuagugccuaucgcuggcuccgaggagcucacagccuagcacugugacacaauucc

SEQ ID NO: 2252935 - RNA, 59 nt, Homo sapiens
uccgcagugucccucagagugaagggagaauagccagcagucugggagggcacugugga

SEQ ID NO: 2252936 - RNA, 65 nt, Homo sapiens
ugaguguauguagugaccagggccagagguacuggacuucugaaacuuggacuuuauacgauuua

SEQ ID NO: 2252937 - RNA, 95 nt, Homo sapiens
gcugucauucaaaauaacaggcauaagaacuucuguuuaaaauagcugggcuuuuugacuagagggcuuuuguguagaagauuuaagaugucagc

SEQ ID NO: 2252938 - RNA, 108 nt, Homo sapiens
uaggggcuugcuguaaugcagucacuuggugaacacauuaugugcuucugggagauaauaagcuacaucgauggucagccgaggagaucugcuccacagagaccccua

SEQ ID NO: 2252939 - RNA, 85 nt, Homo sapiens
acugauaugaggucccuggaguagccagauucacagagacggaaauucucuaugaaucuggcuacuccagggaccucauaucagu

SEQ ID NO: 2252940 - RNA, 73 nt, Homo sapiens
uuugauugguguaccugaaagugacggggcgaauggaaccaagcuagaaacacucuucaggauauuauccagg

SEQ ID NO: 2252941 - RNA, 66 nt, Homo sapiens
ugaaaacucaucaguggggaugugguugaauaaaugaagguucauccacaccauagaugauuauca

SEQ ID NO: 2252942 - RNA, 75 nt, Homo sapiens
ugcuuugucugugcauguuguccaauucuuuguucaagacaccaagaaccuggacaccauccaccaguaacagua

SEQ ID NO: 2252943 - RNA, 65 nt, Homo sapiens
gcuucagacccugcagcugggcugugucuaugugauauggccugcguccagugguaugguuuggc

SEQ ID NO: 2252944 - RNA, 62 nt, Homo sapiens
auggcugggguccuguggaguucuaguaaucuucuuacgauaauaaagcaaccuuaugccau

SEQ ID NO: 2252945 - RNA, 74 nt, Homo sapiens
uuguuuauguuguugcuuuauaguaucacugguaugugugacagugguauguauacuagcgacacuauaaacaa

SEQ ID NO: 2252946 - RNA, 130 nt, Homo sapiens
gaucguugcgugagcgugugugggaagcgcguggucacgugagaucguugcgugagcgugugugggaagcgcguggucacgugagaucguugcgugagcgugugugggaagcgcguggucacgugagauc

SEQ ID NO: 2252947 - RNA, 64 nt, Homo sapiens
gcauuagauucucauaggagcacacacccuauugugaacugugcguguaagagaucuagguugc

SEQ ID NO: 2252948 - RNA, 56 nt, Homo sapiens
gcaaugcaaagcagugauuuuaccaugaaacacacaaaaucauugcacugucuugc

SEQ ID NO: 2252949 - RNA, 55 nt, Homo sapiens
cuccuuugguucuugucaccccauguugcagcauggggcuaguggccagugggag

SEQ ID NO: 2252950 - RNA, 55 nt, Homo sapiens
uugagauggagucucacuguguugcccaggcuggaguacaguggcuccaucucgg

SEQ ID NO: 2252951 - RNA, 66 nt, Homo sapiens
ggucuuacaguaugaguaagaguucucugaacagacagagggaacuugaauguacuggcuaggacc

SEQ ID NO: 2252952 - RNA, 58 nt, Homo sapiens
gugaauagugcugcaauaaacauacgugugcaugugucuucauaguagcaugauuuau

SEQ ID NO: 2252953 - RNA, 79 nt, Homo sapiens
aaugggcauaauuuucauguaaucaaggcagcuaaugaacauauggguaucuggugauaugugaaaaauuaugucuauu

SEQ ID NO: 2252954 - RNA, 87 nt, Homo sapiens
ggccaggcacaguggcucagaccuguagucucagcaggccuauaugggcagauaaccugagguuaggaguuugagaccagucuggcc

SEQ ID NO: 2252955 - RNA, 59 nt, Homo sapiens
cucuagguuggccuauguauauaugauaaucccauauauacacuggagcaaaccuggag

SEQ ID NO: 2252956 - RNA, 67 nt, Homo sapiens
caugauccuucaaaugaagugggauaaggagauccgcccaacaucccaguuuuucugaauagucaug

SEQ ID NO: 2252957 - RNA, 64 nt, Homo sapiens
uucaguggacuuaguagugcuuugcaaaugugacaugaguugagcaggcuuggguccuacugaa

SEQ ID NO: 2252958 - RNA, 55 nt, Homo sapiens
auaaaaaugugcacaugaaagggccuuauauacugcucuuuagucacauuuuuau

SEQ ID NO: 2252959 - RNA, 75 nt, Homo sapiens
auuuuauuagauaccuagcucgugugguuguuuugaauauugaaugaauuaauauaugcuaagugcuaauaaaau

SEQ ID NO: 2252960 - RNA, 66 nt, Homo sapiens
cuguguccuccaaagugugcagagccaauaccuagggguccccaaggugacugagcacgggcacag

SEQ ID NO: 2252961 - RNA, 106 nt, Homo sapiens
acaggaguucaugaacuaucugagcuacauggauagucugcaugaguucaaggccacugcagacaccaugucucagacaggcgugucauagugucaaagcuccugu

SEQ ID NO: 2252962 - RNA, 60 nt, Homo sapiens
ccugucacuguggagaagaaaguggggcugauccuccccuugacuccagggugacccagg

SEQ ID NO: 2252963 - RNA, 88 nt, Homo sapiens
ggagaaucgcuugaaccugggaggcugagguugcagugagcggagauugugccauuguacuuaagccugggugaaaaggugaaacucc

SEQ ID NO: 2252964 - RNA, 65 nt, Homo sapiens
gucaguagaaagugcuggaaacacugaaggaaauucucuucuuaguuucaguacuuucuacuggc

SEQ ID NO: 2252965 - RNA, 72 nt, Homo sapiens
guucacagccugcguugccuaacacugauguuauuugaggcucaauggcucuuuaggcaauagaugguggau

SEQ ID NO: 2252966 - RNA, 58 nt, Homo sapiens
uccuuaaugcaucccaggaacaauuaacuaaagcgggguuucacugggugcaagagga

SEQ ID NO: 2252967 - RNA, 88 nt, Homo sapiens
uuucaaaagaauugugauugauauauuuacagaauuaagucuuuguagccagguguguguguauauuauuauuaccauuuuuuugaga

SEQ ID NO: 2252968 - RNA, 80 nt, Homo sapiens
ucagcuaugucuuuaucagcagugcgaaaacagacuaauacuguuguucuguuacgaguugcuguaaaggcuugaguuga

SEQ ID NO: 2252969 - RNA, 88 nt, Homo sapiens
ccaacguugcggagcuaguaaguguggugucaggauuugaacccaggcagucugggucuugcaccuacaugcuuuguccugccauugg

SEQ ID NO: 2252970 - RNA, 59 nt, Homo sapiens
guucaucuugcugcauucuaccugggacuccaucagcuuggaacgcaaaugagaugaau

SEQ ID NO: 2252971 - RNA, 56 nt, Homo sapiens
cccaugauucaauuaucucucacugggucccucccaugacaagugagaauuauggg

SEQ ID NO: 2252972 - RNA, 57 nt, Homo sapiens
agauagacgguaaacucccugauuagcagugagcugaucuguuauacuuuucuaucu

SEQ ID NO: 2252973 - RNA, 55 nt, Homo sapiens
agggccucuuuguuagugucaugauuucauguauaagaaauuggcaagaugccuu

SEQ ID NO: 2252974 - RNA, 76 nt, Homo sapiens
uaauagaugaauguauugaacuguuggagagguuuucugagguucgaagaccugcacaguuuaccauuaucaguug

SEQ ID NO: 2252975 - RNA, 82 nt, Homo sapiens
gguuauuaauccccuguuggauggugauaugguuuggauuuguguccccaccaaaaucucaugucaaauuggaggaagaacc

SEQ ID NO: 2252976 - RNA, 77 nt, Homo sapiens
aggcauaaacaugugugcuugauguaaaaaguauaguuaaaaaguuacuuuaggccaggcacaguggcucaaugccu

SEQ ID NO: 2252977 - RNA, 93 nt, Homo sapiens
uuaggcggcgaacucuuauuguugccaugcuuucauuugaaccauggagaaauggcaaaucagaggcauggacaaaaucauagagcuacuuga

SEQ ID NO: 2252978 - RNA, 81 nt, Homo sapiens
uguucucugcuauguuucuaaucaguacagugaccauauauuguuaaguaaacauugagagacaagaucuggcagaggaca

SEQ ID NO: 2252979 - RNA, 66 nt, Homo sapiens
gugucuuguagacaauguauaguuuuaguuugguguuuugcuguuauuguuguuguuuugagacac

SEQ ID NO: 2252980 - RNA, 82 nt, Homo sapiens
aguuguaggguacaugugcacaacgugcagguuuguuacauauguauacaugcgauauguuggugugcugcacccauuaacu

SEQ ID NO: 2252981 - RNA, 63 nt, Homo sapiens
gccaucugaaaagcacacaugaguuuugcuauauuuuggacucucauauugcuuuuccauggu

SEQ ID NO: 2252982 - RNA, 130 nt, Homo sapiens
ugaucauauuuauauucucugauuaguguguuucacaagccuuuuguuuguucguuuuucuuaaaccgcuuaauugagguaugauugacauauaaaaagcuaugcauauuuaauauauaccuuuugauca

SEQ ID NO: 2252983 - RNA, 91 nt, Homo sapiens
uaugaaccaggaauuggucucucaccagacaccaaaucugccagcaccuagaucuuggacuuuugugagaaaucuauuucuguuguuuaua

SEQ ID NO: 2252984 - RNA, 65 nt, Homo sapiens
uucucuugggugugcuuuugggguguuagucauaaauucuuuaccucagccaaugcccagaagag

SEQ ID NO: 2252985 - RNA, 109 nt, Homo sapiens
aggucugggucuuuuccuguggagaguuaagcuuuuagguccuccucaccugaggccccgggcugacggaggcauuggaagcuuguaaaagucagggcugagaugaccu

SEQ ID NO: 2252986 - RNA, 77 nt, Homo sapiens
gcccaauuuaaaaaauccuuggauuuuuauucugggugauaaccaguguuagauaauuagaggguuuuaaguugggu

SEQ ID NO: 2252987 - RNA, 89 nt, Homo sapiens
ggguuuuggaagggcucugucuuaguuugggguggggauaguuggagcugauuauguguaccucaaucugaggccuuuccucaaaaucc

SEQ ID NO: 2252988 - RNA, 75 nt, Homo sapiens
ccccuggcccauucauaaguaaaugauuaccuaauugugagguugggaauggaagacauuaugauggggcagggg

SEQ ID NO: 2252989 - RNA, 76 nt, Homo sapiens
ggccuaaccaagcaaacuuucauuguuaugugguuucuaggucuccuacagggcaaaaaguagugcugguuaggcc

SEQ ID NO: 2252990 - RNA, 82 nt, Homo sapiens
ugcagaugcccccuggacuguacuccuggccaguguggaccccaaagcuaccucagugacagucaagggccugguuccugca

SEQ ID NO: 2252991 - RNA, 55 nt, Homo sapiens
uaaggaaggcugugugcuuuuaaaguuuguugaaacuuacacuuugcuuuucuua

SEQ ID NO: 2252992 - RNA, 115 nt, Homo sapiens
cauuuuauuaauggagcuaauugcaugcacuguauaggaucuugcggaaaauaaauuacaguauauaaaaugucuccuaguauggugcauuguacaugguugacauucaaaaaug

SEQ ID NO: 2252993 - RNA, 76 nt, Homo sapiens
guucugggaagauucagacaugguccuugccccccagaguaaaggggggcaaggacucccugggucauucuaggau

SEQ ID NO: 2252994 - RNA, 69 nt, Homo sapiens
caagcucucuuggugacuuaaaauguucccauuucucauaugaaacacagaagugccaagagccaauug

SEQ ID NO: 2252995 - RNA, 95 nt, Homo sapiens
ggagaaagcucuauacuguuuccuguagcgauuuuaguaauuuacugggaauggaaauuaguaaaaucgcuacaggaagcaguauugcuuuuuuc

SEQ ID NO: 2252996 - RNA, 78 nt, Homo sapiens
cagugucuuuuaccuuugucaguuacucaccuauuauuauaugugguuuuuuugcaagggccaaagauugagacauug

SEQ ID NO: 2252997 - RNA, 67 nt, Homo sapiens
auugaguacuuagugucauauacuaggaauuuccuuugguauuuucaugugcacuaugucauuuaau

SEQ ID NO: 2252998 - RNA, 130 nt, Homo sapiens
cacacaggccucgggccucugggaagcaagugcauucuugggccucuguuuagaagguaucaaagagcuaccuaacaggcuccuaggggugcaccuugugguucacugaugggcucgcagagccagugug

SEQ ID NO: 2252999 - RNA, 56 nt, Homo sapiens
ugucaugucuuuguguaucaauuacuaauccauagguugaugcaaaagucauugca

SEQ ID NO: 2253000 - RNA, 64 nt, Homo sapiens
cuguuggcauugcugcugacccuccaacuuugaacuuagaagcagaggauagcaaugccaacag

SEQ ID NO: 2253001 - RNA, 57 nt, Homo sapiens
uguaaauuggcacacuggcauccuaggacugcauugaugccagugugucaauuuaua

SEQ ID NO: 2253002 - RNA, 85 nt, Homo sapiens
gguguccagguuggagugcaauggcaugaucuuggcucaccgcagccucugccucccagguucaagcuauucuccugccucagcc

SEQ ID NO: 2253003 - RNA, 74 nt, Homo sapiens
ucuucaagagucaauauguggauaucugagugucaaaucuggcaugcacuguauuuaaguaucacuuaggaaga

SEQ ID NO: 2253004 - RNA, 119 nt, Homo sapiens
auuagggcaauguuuaauuuacugucucauggcuuuuugaguaaauauaaauugucauacuaaagugacagguguaaaacccaggauggcuguguuagagagguuaaucugcuguuaau

SEQ ID NO: 2253005 - RNA, 100 nt, Homo sapiens
aaauguauuugauugguuagaauggaaaugcgagguuaguugguggcuucugauuggcuaagccucuacauucauuuuacuguuuauguugguaccauuu

SEQ ID NO: 2253006 - RNA, 128 nt, Homo sapiens
aucuccugaccucgugagccaccugccucggccucccaaagugcuggaauuggccgggcgcgguggcucacgccuguaaucccagcacuuugggaggccgaggcgggcgaaucacgaggucgggagau

SEQ ID NO: 2253007 - RNA, 82 nt, Homo sapiens
ccagccugagcaacauagugagacccccaucucuaccagacauuuuuuuugagauggagucucacucuguugcccaggcugg

SEQ ID NO: 2253008 - RNA, 116 nt, Homo sapiens
ggcuggagugcaguggugcgaucucauugcaaucuccgccuccgggguucaagugauucuugugccucagccucuggaguagcugagauuacaggugugcaccacugcacccagcu

SEQ ID NO: 2253009 - RNA, 111 nt, Homo sapiens
cacuaaagaacuaguuaagggggacacuggucucauggcaugagagugggccucagcuuuuucaucuguagacugggaauaguauugcccccuggaguggguugaauagug

SEQ ID NO: 2253010 - RNA, 84 nt, Homo sapiens
guugcacguaauagucucaaacuccuggacucaagccaucugcccccauuggccuuccaaaguguugggauuauaggcaugaac

SEQ ID NO: 2253011 - RNA, 75 nt, Homo sapiens
cagugccaaucacagacugagccaaauagaggugaaauuuucaaugugcucaucauguggaccauggcuuugcug

SEQ ID NO: 2253012 - RNA, 55 nt, Homo sapiens
uugagauggaguguugcucugucacccaggcuagagugcagugcugccaucucgg

SEQ ID NO: 2253013 - RNA, 129 nt, Homo sapiens
gcagaguguaauucccagcuccuugacuuagacuuggccauaugacuugcuuuggccaaugguauguggccgaaguaaaagugugcuaguucugagccacaucauucauuucuacuugcugucuugugc

SEQ ID NO: 2253014 - RNA, 105 nt, Homo sapiens
aggguuccucacugggaacgugggcuucugacacuucaaaacugccaauuugcuggggcaaaggcaaguuaaaaaugucauaaaguuuuccaguugucuuuuucu

SEQ ID NO: 2253015 - RNA, 79 nt, Homo sapiens
ggauuggauuauuuggucaauaaguauuuauuuggcauuuacuuugugccaaauacuuucauguugucuuguuuaaucc

SEQ ID NO: 2253016 - RNA, 55 nt, Homo sapiens
cugccuuggaaaaugugguaauuaaaaagugcuuuaauauaacauccaggagcag

SEQ ID NO: 2253017 - RNA, 82 nt, Homo sapiens
agugguuacuuguuguggauuaaauuugcauuucccugaugacuacugaugcugaauucauuccauaugcuuacuaaccauu

SEQ ID NO: 2253018 - RNA, 56 nt, Homo sapiens
guugguucuguuuauaugacggauuauguuuauugauuugcauauguugaaccagc

SEQ ID NO: 2253019 - RNA, 76 nt, Homo sapiens
auauagauacuauagcacauauauuucccaaaacauaauauaauaugugugugugugugugugugugugugugugu

SEQ ID NO: 2253020 - RNA, 60 nt, Homo sapiens
cucaugcacugaguccaccucuggacucugugggggccagaggaccgguuuagucaugag

SEQ ID NO: 2253021 - RNA, 129 nt, Homo sapiens
ggauauauacccacaguaggauugcuggaucauaugauagcucaauuuuuaguuuuuuaaggaaacucuaaauuguucuucauagugauuguacuaauuuacauuccuaauaacuguguaugaaggucc

SEQ ID NO: 2253022 - RNA, 59 nt, Homo sapiens
ugagacugaguuuugcucuuguugcccaggcuggaguacaauggugcgaucucagcuca

SEQ ID NO: 2253023 - RNA, 130 nt, Homo sapiens
auuugauaaaauuaagcccuuuauauauaaagaagguucuuggcaagucuuuuaaguuugaugaaaaaguuuauugaacuuaaaagacuugccaagaaccuacuuuauaaagggcuuaauuguaucaaau

SEQ ID NO: 2253024 - RNA, 89 nt, Homo sapiens
ggaguuucacucuuguugcccaggauggagugcaauggcgcaaucuuggcucagugcaaccuccaucucucggguucaagcaauucucc

SEQ ID NO: 2253025 - RNA, 77 nt, Homo sapiens
uugcuugaaccuggaaggcggagguugcagugagcugagaucgcgccauugcacuccagccuaggugaaaagagcga

SEQ ID NO: 2253026 - RNA, 55 nt, Homo sapiens
cauucccagugguuagcucuggucuucaggagacuagaagcagcccucgggaaug

SEQ ID NO: 2253027 - RNA, 67 nt, Homo sapiens
cacauuuacauguauguguuuauggcugcauauguauguaucuguguuugcauauguguguaaugug

SEQ ID NO: 2253028 - RNA, 69 nt, Homo sapiens
gguucacaagaguuacagacagacacuuugcuguuuuuauuucagcaguuugugguuacugugugagcu

SEQ ID NO: 2253029 - RNA, 80 nt, Homo sapiens
ugguuauagaacccaagggccuagaacaaacauaaauaguagcuaggaagguguuacaguguaggccuugggugagacca

SEQ ID NO: 2253030 - RNA, 87 nt, Homo sapiens
ggagaauugcuugaacccgggaggcggagguugcagugagccaagaucgcaccacugcacuccagccuugugacagagcgagacucc

SEQ ID NO: 2253031 - RNA, 82 nt, Homo sapiens
ugguuuggugagcaaggguaggggccagagggaaguagaugaauagucuugccacaucccuuucccacccuucacagggcca

SEQ ID NO: 2253032 - RNA, 66 nt, Homo sapiens
augaugcugggauaacuggcuagccaauaugcagaagauugaaacuggaccccuuccagucaucau

SEQ ID NO: 2253033 - RNA, 101 nt, Homo sapiens
aacguugguuggcuauucaaagaaguaaugcuuauaauuucuuuauuaggauucuugguauggaguaauuaguaagcacucaaaaaaugcagaucauuguu

SEQ ID NO: 2253034 - RNA, 55 nt, Homo sapiens
cagggcccuaagauacacaucagaaacaaacguccucauugugucuugggcccug

SEQ ID NO: 2253035 - RNA, 80 nt, Homo sapiens
cgauguucggggcccauuaguuguuuguugugaagagacuuucugugcauuguaacaacuaaacauuucuccagacauug

SEQ ID NO: 2253036 - RNA, 75 nt, Homo sapiens
gauacagaaggacaguaccacucaugagcucacauuugggcuggcucaaugaaugcagcacuguuuuucugcauc

SEQ ID NO: 2253037 - RNA, 81 nt, Homo sapiens
uuacuguaggccucagagguuugaaaugucuuuucuuuguuucuacgaaaaguguguuuccaaccuguggaaucauaguaa

SEQ ID NO: 2253038 - RNA, 59 nt, Homo sapiens
uucucaauggcaacuuguugcuuggauucucaucagaagcaaauaauugucuuugaggg

SEQ ID NO: 2253039 - RNA, 59 nt, Homo sapiens
ugagacugaguuuugccuuuguuguccaggcuggagugcaaugacacaaucucagcuca

SEQ ID NO: 2253040 - RNA, 103 nt, Homo sapiens
ucacagggccuagugcccaggugauaugacuuuccucuacuuccuaggcuuuuccuaagaagggauuguaauauauugcugggucagaaccuaggucguguga

SEQ ID NO: 2253041 - RNA, 77 nt, Homo sapiens
caucccacaaaagugacuuagugccccauuuacaacacaguugguaaaaagggugaagaucacuuugaacuggggug

SEQ ID NO: 2253042 - RNA, 60 nt, Homo sapiens
uugagacggagucuugcucuguugcgcaggcuggagugcaauggcgugaucuccgcucaa

SEQ ID NO: 2253043 - RNA, 67 nt, Homo sapiens
uugaggaggcagucucuccauucucagaucucaaacucugugcugggagaaccacugcucucuucaa

SEQ ID NO: 2253044 - RNA, 86 nt, Homo sapiens
agggaacacaguaaauacaggagugggauuugaguccugguacuccagggccagugcucuucacuguuagguuaaacugauuccuu

SEQ ID NO: 2253045 - RNA, 66 nt, Homo sapiens
auagguugaguaguaaggauauuaucuuuguuggaggaaaaacagucuuuauuauuuuaggccuau

SEQ ID NO: 2253046 - RNA, 56 nt, Homo sapiens
uauugucacuaaaggaagcugggcggucaccagcacuggcuuucuaugcgacagua

SEQ ID NO: 2253047 - RNA, 61 nt, Homo sapiens
uucagcaguggccaguggaaauggaagaaaagaggauucuccccacaugaccugcucugga

SEQ ID NO: 2253048 - RNA, 78 nt, Homo sapiens
ugguuuuugucguugguucuguuuaugugcuggauuauguuuauugauuugcauauguugaaccagccuugcauccca

SEQ ID NO: 2253049 - RNA, 67 nt, Homo sapiens
agugguaagaguggaaauccuugucucauuccaguucuuagagaaaagcuuucaacuguuugccauu

SEQ ID NO: 2253050 - RNA, 59 nt, Homo sapiens
ugugaauuuugguauacacaaggguccugaaaccaauucccugaauauaccaaggcaca

SEQ ID NO: 2253051 - RNA, 83 nt, Homo sapiens
gguaacaucuuuauagcagugugaggacagacuaacacaucaucuguauuaguccguuuucacacugcugauaaagacauacc

SEQ ID NO: 2253052 - RNA, 81 nt, Homo sapiens
aguuuuaggguacaugugcacaauguacagguuaguuacauauguauacauugacaugcuggugcgcugcacccacuaacu

SEQ ID NO: 2253053 - RNA, 79 nt, Homo sapiens
ugcuuuacgugaggugguacaauauuaacucaaaauagaccacgaugaguuaagaauacacaucauaauuccuagagca

SEQ ID NO: 2253054 - RNA, 60 nt, Homo sapiens
guauuggaacauccuaaauggaccugaacauccaaguuuguccaaaacaguguccaaugc

SEQ ID NO: 2253055 - RNA, 104 nt, Homo sapiens
aguggcccuugggaagcugcacagagagaagaaugaacaugaguucuggugucagagauauuuaaacucacauucuuucuugguacuaguuuccuuuggccauu

SEQ ID NO: 2253056 - RNA, 69 nt, Homo sapiens
ccagaggguuaaguuucaauugaaaaguaaagguucuuuuuuagaucaacauggaacucuaucuucugg

SEQ ID NO: 2253057 - RNA, 65 nt, Homo sapiens
uauggcagugccugucuacauugguggagggaaugugccuaccacauuguagagggcauuccaua

SEQ ID NO: 2253058 - RNA, 78 nt, Homo sapiens
cucccucuggguucccugaagauacagaguuugggggugagaggcccgccagacugcacuuuuuaggcuaggcgggag

SEQ ID NO: 2253059 - RNA, 92 nt, Homo sapiens
uagaaaugugcaaaagucauaacugcauuuucugauugugugugcgauggcauagcaaucaaaugaagauguaaaagcuuuuauuguuuuua

SEQ ID NO: 2253060 - RNA, 59 nt, Homo sapiens
ggguuuuccuucugcauuggagugcuuuagaaagaaggaagccagugcaaggaaagccc

SEQ ID NO: 2253061 - RNA, 63 nt, Homo sapiens
gggguggucguggagucucuggcuuguacccagggugcgagucgcacccacgacgggcacccc

SEQ ID NO: 2253062 - RNA, 55 nt, Homo sapiens
uuauaguuuuucaccuggagaaacacauuuguucugcagcuguggaaagcaauga

SEQ ID NO: 2253063 - RNA, 69 nt, Homo sapiens
auguugcuucuacaggagaccuuaaugacccacagaaccauaucaguaaagucacuggagaaggaauau

SEQ ID NO: 2253064 - RNA, 59 nt, Homo sapiens
agcaagacauggcuuccaaaugcggcugguaagaggcucugggagaguucauucuugcu

SEQ ID NO: 2253065 - RNA, 59 nt, Homo sapiens
agaguucuuaugugugcacgaccuaugagacuagaaaacuguaacacauggagaacucu

SEQ ID NO: 2253066 - RNA, 82 nt, Homo sapiens
ugccaucagagacccaguagccagauguagcugcugauuacgaaagacaggaucuacacuggcuacugagccauugagggua

SEQ ID NO: 2253067 - RNA, 80 nt, Homo sapiens
cugccagacuggguugaucucagcccuaagguaacuaugaagcucccuuagguuaugauaaauuuaguuauuauuggcag

SEQ ID NO: 2253068 - RNA, 71 nt, Homo sapiens
uguggguggagggaaggacuggacuaaggcaagggggagcaaaguucaguccauuuccuuggucacucgca

SEQ ID NO: 2253069 - RNA, 77 nt, Homo sapiens
ucacuugaacccaggaggaggagguuguggugagccgagauugcgccauugcccuccagccugggcaauaacaguga

SEQ ID NO: 2253070 - RNA, 55 nt, Homo sapiens
caguuuuccucacugucagucccuguaauccacauucugucacugaggaagacug

SEQ ID NO: 2253071 - RNA, 108 nt, Homo sapiens
gaaguauugaggauagcauuucaaaaaugguauuuugauuauuuuuuaaagacuucuuuuugagauacauaauuaugaaugaaaugaugugcugucuguguuugcuuc

SEQ ID NO: 2253072 - RNA, 65 nt, Homo sapiens
ggugaaucugacaauuauguaucuugggguugcucuucucgaggaguaucuuugugguguucucu

SEQ ID NO: 2253073 - RNA, 65 nt, Homo sapiens
ggugaaucugacgauuaugugucuugggguugcucuucucgaggaguaucuuugugguguucucu

SEQ ID NO: 2253074 - RNA, 60 nt, Homo sapiens
acauauugaugacaggaaucgccugacaaucacuaagcugauggccuguucuccauaugu

SEQ ID NO: 2253075 - RNA, 59 nt, Homo sapiens
gagugaucugcaugucaauucagugguacccaaucacugggcaagauaucaugacacuc

SEQ ID NO: 2253076 - RNA, 89 nt, Homo sapiens
gcaccgucccaggagccacaguccacaucuccugcccacccugugaggugugagucagucuguguagggcugggcuugguagacagugc

SEQ ID NO: 2253077 - RNA, 72 nt, Homo sapiens
guguuauucaaucagaccuaauuuauauuucagcauaagcuggaaauaaaauagaguuugccugguuaaugu

SEQ ID NO: 2253078 - RNA, 103 nt, Homo sapiens
gucccacucuguugcccaggcuggagugcagugaugguaucuugacucagcaccuccuggguucaagcaauucugcugccucagccucccgaguaacugggau

SEQ ID NO: 2253079 - RNA, 56 nt, Homo sapiens
uugagauggaguuucacucuugucacccaggcuggagugcaauggcccaaucucga

SEQ ID NO: 2253080 - RNA, 62 nt, Homo sapiens
uuauucauuaauugcuaagguuugaaagcaaccaagauguccuucaguggguuaauggauaa

SEQ ID NO: 2253081 - RNA, 129 nt, Homo sapiens
gaggugggggcccucauggagaacaucugcuagggcaguguggaagggaaauguggggucagagcccccaaacagagucccuacugggguacugccuaguggagcuaugagaagaaggccaucauccuc

SEQ ID NO: 2253082 - RNA, 65 nt, Homo sapiens
uuguaauguuaggguguccauguuagaccuuuccugccuucucuugugggcauucaauguuauaa

SEQ ID NO: 2253083 - RNA, 66 nt, Homo sapiens
gcuaucuguagucucaugguuccugcggugacuucacccacuccagugccauggcugcuagauggc

SEQ ID NO: 2253084 - RNA, 63 nt, Homo sapiens
uaguaaaacaaagaagaagguguaaguggaacuauauuagagcaaaguuucuauguuuuacua

SEQ ID NO: 2253085 - RNA, 72 nt, Homo sapiens
cgugauauugagcuuuuuaaaauauaguuguuggccacauauaugacuucuuuugaaaagugucaguucaug

SEQ ID NO: 2253086 - RNA, 61 nt, Homo sapiens
gcacuuuguccaaggucaacuggcagaaacauguuuaaauucagugcugugggcaaggugc

SEQ ID NO: 2253087 - RNA, 70 nt, Homo sapiens
gauuuguagccuggggguuuucuaaaguaucuaaaaauuuuggguaguguaaagcacuccaguuagaauu

SEQ ID NO: 2253088 - RNA, 56 nt, Homo sapiens
cuugagcucaggaguuugagaccagccuggucaacacagcaaaacccugucucaag

SEQ ID NO: 2253089 - RNA, 71 nt, Homo sapiens
gaauucaguuugcuaguauuuuauugagaauuuuugcaugaauauucaucagggauauuggucuguaguuc

SEQ ID NO: 2253090 - RNA, 63 nt, Homo sapiens
gcucaugaaugucuguggucuuuagugcuaccaauaugcuaaugacuucagaagcuucagagu

SEQ ID NO: 2253091 - RNA, 60 nt, Homo sapiens
uauuuuagagaaccucuugaaaguggccaccucggccuuuugcaauaagucacuggaaua

SEQ ID NO: 2253092 - RNA, 68 nt, Homo sapiens
uucaaggugagauuugggugaggacacagaggcaaaguguaucaccuugagagaccuuauccuuugag

SEQ ID NO: 2253093 - RNA, 130 nt, Homo sapiens
uugcaucauacuccauggauugauauaccacaguuuggccauagguuauuuauuauauuuuguaauuacaaagaauguggcauugaauaaccuuggacuuuguauuguuggccaucugucuuccagguaa

SEQ ID NO: 2253094 - RNA, 84 nt, Homo sapiens
aauauacaguugacauggaaguagguauacauuacauacuaacuauaauguuaagcccauuuacuauguugaugaaacuauauu

SEQ ID NO: 2253095 - RNA, 70 nt, Homo sapiens
gcuucuccacuguacucaucccauaugcacuuguaauuaagaaguguuuugugaggagguacuuugaagc

SEQ ID NO: 2253096 - RNA, 78 nt, Homo sapiens
ucugauuuauucuccacaguaaucacacaagguagucauuucuugcuccauuuuacagguggagaaguaaggcucaga

SEQ ID NO: 2253097 - RNA, 79 nt, Homo sapiens
gguuccuggggcuuggcacgugguggggcucggaagcuccugcucccagcuccccacuguccgguccccagggaggacc

SEQ ID NO: 2253098 - RNA, 92 nt, Homo sapiens
ccguccaaccacccauccagugagcauugguugaacagauuguguugaaugcaacaauggaauaaugucaccagguuuaugggugaugaugg

SEQ ID NO: 2253099 - RNA, 56 nt, Homo sapiens
caugcuggguaaagguggugaagaugugccuuagguucacauccucucccaacaug

SEQ ID NO: 2253100 - RNA, 60 nt, Homo sapiens
uucuauuuucaucauauaugggauauccuugcauuucuccuuuuuguaguggaaguagga

SEQ ID NO: 2253101 - RNA, 75 nt, Homo sapiens
ccagagucugugccucaagcuaaagaagugaaagcuccuuucauucauucauccagcuugaggaagagacccugg

SEQ ID NO: 2253102 - RNA, 73 nt, Homo sapiens
guuguggucagaaaagguaguuaauaugauuuugauccucuuaaauuuguucagacauguuuuguggccuaac

SEQ ID NO: 2253103 - RNA, 68 nt, Homo sapiens
cuuuggcuucuggacuauugugcagccauuucaaaugaaucauuuugucaauguaucaugagccaaag

SEQ ID NO: 2253104 - RNA, 65 nt, Homo sapiens
uuuuuuguagagacaggaucucacuauguugcccaggcugguuuugaaccccugcucucaagaaa

SEQ ID NO: 2253105 - RNA, 130 nt, Homo sapiens
gccucccaaagugcugggauuacaggcgugagccaccgugcccagcuguuauagcuuaauuuuagaaagaauggcauuuuuagggcugggugcgauggcucaugccuguaauccuagcacucugggaggc

SEQ ID NO: 2253106 - RNA, 83 nt, Homo sapiens
cucaaaccacucuuguuacuugccaagauucauaauugauagacaaugaugagaucuguaaagucugacaugguuauaaagag

SEQ ID NO: 2253107 - RNA, 58 nt, Homo sapiens
gugagauggagucuugcuuuguugcucaggcuggaguacaguggcgauuuccucucac

SEQ ID NO: 2253108 - RNA, 118 nt, Homo sapiens
gaggaugaaacaagaugauagaucaugguggcauguagucugggaccuggauugucgugccacagaucacagcucacagucuaugugcaaugccccugaauguugcccaccuguccuc

SEQ ID NO: 2253109 - RNA, 64 nt, Homo sapiens
agcuauuugaaguugcagagaugaucagggaagccuuccuucucacuguggaacucaaaaagcu

SEQ ID NO: 2253110 - RNA, 91 nt, Homo sapiens
ugucacaaggcaucuuuauccugucaguaaauauuuuaauucuacaugaagcagaaaauuguuuauuguugggguggaugcaaaagugaua

SEQ ID NO: 2253111 - RNA, 65 nt, Homo sapiens
auaggaaguuucuugauuacuuauucaaucuuuuuacuuuuaauaggucuaaggagacuuucugu

SEQ ID NO: 2253112 - RNA, 63 nt, Homo sapiens
gccugggugcacaguggguucugccauccggccucggugcgcagugggcugugccauccaggu

SEQ ID NO: 2253113 - RNA, 64 nt, Homo sapiens
gcgguucuuaucucaauguaucagaagacucagaucacaugggagaaugagaguacacccccgc

SEQ ID NO: 2253114 - RNA, 76 nt, Homo sapiens
auauugaaggaggugcucacucucggaugcugaugcuacacuugccaacccugagagugagcaucuccuuaaaugu

SEQ ID NO: 2253115 - RNA, 65 nt, Homo sapiens
acuauggcauuauuuugauagacagcagaucucuaccuaucucuguguauuaaauaauguuaagu

SEQ ID NO: 2253116 - RNA, 55 nt, Homo sapiens
aguuagaagguauagccauuuuuuuaaggguugugagugguauuaccuuuugauu

SEQ ID NO: 2253117 - RNA, 86 nt, Homo sapiens
guguggauugcguguguugcagggcagggguugugaauugcucuucaaucacagcuacuccucugucuugugcaagccauuggcau

SEQ ID NO: 2253118 - RNA, 67 nt, Homo sapiens
uugaaccugggaggcagagguuggagugagcugagaucaugccacugcacucuagccugggugacag

SEQ ID NO: 2253119 - RNA, 58 nt, Homo sapiens
gguuuugagcagagaagugcccugcgcugcagcagcugacagccaggcucugcaaacc

SEQ ID NO: 2253120 - RNA, 79 nt, Homo sapiens
gcuucauagacaaagcagcaggucaguggccaggacccuggauucuggcccaguucugcguuuugcucucuaugugagu

SEQ ID NO: 2253121 - RNA, 56 nt, Homo sapiens
uccacagacucaugcuccugaagcaagccacaugugugguggcaugaggguguggg

SEQ ID NO: 2253122 - RNA, 100 nt, Homo sapiens
cucugcuuuacauggcuacguuguuugagggcaggaguuggugagaauuaguuuggaaaacugacuucucucauucagacauagcuuuucuggagcagag

SEQ ID NO: 2253123 - RNA, 66 nt, Homo sapiens
gcuauaggaagagaaguagacugaucagagacuagcuuuggagauagaagcuacucuucuuguggc

SEQ ID NO: 2253124 - RNA, 63 nt, Homo sapiens
ugcuccuggcucaucacacuaacagcagccaacguguguuuagugcuuacgaugagcuaagca

SEQ ID NO: 2253125 - RNA, 83 nt, Homo sapiens
uagggcuguuuugaagacuaauuuagauaauguaacuaggguaggcaguuccaugucugagucaugguacuucugaaccccua

SEQ ID NO: 2253126 - RNA, 58 nt, Homo sapiens
caaugugauugaaucugcucaaauugcuuugggcaguauggccuuuuuaaugauauug

SEQ ID NO: 2253127 - RNA, 81 nt, Homo sapiens
gccccgccaacccaguguucagacuaccuguucaggaggcucucaauguguacaguagucugcacauugguuaggcugggc

SEQ ID NO: 2253128 - RNA, 110 nt, Homo sapiens
uguuuuauggguguauguuucucccugucccugugaccguggagaaaaaagugcuaaauaaucaugggguaaaggcacaggggacacaucaagauaauuuacauagaaca

SEQ ID NO: 2253129 - RNA, 76 nt, Homo sapiens
auguauaaucuuaguuuagauuagcaauucgggaucucuuuuucccugaauucuaaccauuaagccaagcaagcau

SEQ ID NO: 2253130 - RNA, 66 nt, Homo sapiens
guuagcaguggauggguggagaauucaaggguuucugcuuguguuuuuaccacccuccauucuggc

SEQ ID NO: 2253131 - RNA, 57 nt, Homo sapiens
cucuuugaugugaaccgugguugucggccucugaagaaaucauuucacaccaaaggg

SEQ ID NO: 2253132 - RNA, 76 nt, Homo sapiens
gcccgccaccaugccuggcuaauuaguagagauggggguuucaccguguuggccaggcuggucucgaacucuuggc

SEQ ID NO: 2253133 - RNA, 82 nt, Homo sapiens
aauguaucaugauuuugcacuauaggaaaaugugucuugcugagauguacaauauuucuaaguguauucuguccauugcauu

SEQ ID NO: 2253134 - RNA, 58 nt, Homo sapiens
ugacaagugcaaauguaaagugcagugccaucuuccauugcaguguccucacuuguca

SEQ ID NO: 2253135 - RNA, 57 nt, Homo sapiens
uauagcuugauuauggugaugguuacucaacuguucauuacaaaaacucaagcugua

SEQ ID NO: 2253136 - RNA, 67 nt, Homo sapiens
agugucccucaguagucaugaguaaacuuuuuaaaaaaaagugguuuuucagacuuugagagagacu

SEQ ID NO: 2253137 - RNA, 70 nt, Homo sapiens
ucucgauuggacuuuaagauagagauguugaguaggcagcuggauaugcuaguugagaguucagaggaga

SEQ ID NO: 2253138 - RNA, 70 nt, Homo sapiens
cuuuacagcagcaucccaugcugcaugguacaaauuuacuguauuaguccauuuucaugcugcuauaaag

SEQ ID NO: 2253139 - RNA, 75 nt, Homo sapiens
gucagucaggcuucagguacugggggaguauggccagcagcccccagccaagcucuaguccugagguaggcuggc

SEQ ID NO: 2253140 - RNA, 104 nt, Homo sapiens
ccaggaaguggagguagcagugagccgagauggugccauugcaccaccacccagguuggagugcgguagugcaaucauggcucucugcagccucaaauuccugg

SEQ ID NO: 2253141 - RNA, 56 nt, Homo sapiens
uugagauggaguuucacucuuguuguccagacuggagugcaauggcgccaucucag

SEQ ID NO: 2253142 - RNA, 73 nt, Homo sapiens
uaacucacaguuuguuguuuuuauuucucacuucccuggugagaggugaaggucucaauaaauaaguaaguug

SEQ ID NO: 2253143 - RNA, 68 nt, Homo sapiens
guuuagagguaagugaagcaagaacuaggcuuucaaaaaauuuuggucucuuaaucacacuuuuaagc

SEQ ID NO: 2253144 - RNA, 85 nt, Homo sapiens
gaagcaauugugaugaaugaagggacugggguaucauuguuuagaugugaugauccagugaguuucaguucuuuguuaauucuuu

SEQ ID NO: 2253145 - RNA, 122 nt, Homo sapiens
uauuuuuugcuuugucuuuuagagguggauauuauuaaacaguauguuauugaauugggagcugaguucaaguacuuauuugauaauuagguuuauuuuuaaggaguaguuuaaacaaaaua

SEQ ID NO: 2253146 - RNA, 70 nt, Homo sapiens
ugcuucuuguucagagaauaaaaauuggugucugaaugcccaguuuugcuucucaugagggacugaagua

SEQ ID NO: 2253147 - RNA, 89 nt, Homo sapiens
auucugaccacucuggucaugauguacuucacaucacuuuuuauaauaaaaaguguuucugcaguagguuugccaauauuguuuagaau

SEQ ID NO: 2253148 - RNA, 58 nt, Homo sapiens
uuuuuuuuggaacaauucagguuuaauugcugugaccuagaugguguucuagagagaa

SEQ ID NO: 2253149 - RNA, 69 nt, Homo sapiens
guggcaaggaaaugcugcucacucacaggcucccucccuugagggcaccagcacaccauuuccugccac

SEQ ID NO: 2253150 - RNA, 80 nt, Homo sapiens
cuugguggacaucugggaguuucuggaggaguccagaaaaguuuggaagauucuagaagauuccagaagauuccagcagg

SEQ ID NO: 2253151 - RNA, 71 nt, Homo sapiens
caggugguauuugguuauaugaguaaguucuuuaguggagauuugugagaaccggguacacccgucaccug

SEQ ID NO: 2253152 - RNA, 98 nt, Homo sapiens
ucugccuucaaauuuuauuagguuggugcaaaguaauuguuguuuuugcaauuacuuuuaguggcaaaaacagcaauuauuuuugcaccaaucccaga

SEQ ID NO: 2253153 - RNA, 91 nt, Homo sapiens
gguaaaauuuagcauuugaggaauguguguuaaagauacacaagaauuccuuguacuauuuuugcaacauuucuguaagucugaaauuacc

SEQ ID NO: 2253154 - RNA, 58 nt, Homo sapiens
gauaucccuuagagcggggugguucugaaguuggagccuggcccauuuaagggacauu

SEQ ID NO: 2253155 - RNA, 65 nt, Homo sapiens
gaaggaucuggagucuugaugauuuucaaaugaacucaucugaauucucagggucuucuuccuuc

SEQ ID NO: 2253156 - RNA, 63 nt, Homo sapiens
aagauuuggauuccuaauaagcuuuccuacuuaagaaagugaggaucucuaggaauuuaucuu

SEQ ID NO: 2253157 - RNA, 58 nt, Homo sapiens
ugaugagauaaaccaucucuuaagugcagaaauauuugaugaugguuuccuuuccuca

SEQ ID NO: 2253158 - RNA, 65 nt, Homo sapiens
augauguuaaguaggaaucccauuucgguuuucucuguagugugggucaguuuuucugacaucau

SEQ ID NO: 2253159 - RNA, 59 nt, Homo sapiens
gaauugcacaaaaacugcuuguucugcaaauuuaguuuacaacaauuugagugcaguuc

SEQ ID NO: 2253160 - RNA, 57 nt, Homo sapiens
agaacugguuauuuaaaggcugaaaugcuuccguuuugcuugugaauagccacaucu

SEQ ID NO: 2253161 - RNA, 59 nt, Homo sapiens
cugguuuguaaaguuccugagauuucaauaaugggcucucacaaaccaguauaggccag

SEQ ID NO: 2253162 - RNA, 75 nt, Homo sapiens
cauuuuuaaaauaauaguauuuggauguuggugagcuuggagugaagcuggcaccauacacuguuguugagagug

SEQ ID NO: 2253163 - RNA, 56 nt, Homo sapiens
agcugcauuuuuaacaaguguagaucaucugaaucacacuuaagagaaaugcagcu

SEQ ID NO: 2253164 - RNA, 66 nt, Homo sapiens
ucugucaucgguauuaucaccuauguggcagcgaaguguuccauagucauagugcugaugcucaga

SEQ ID NO: 2253165 - RNA, 86 nt, Homo sapiens
aucuguacuuuaguguaauugauagguucuaagcagguguugugccugcagcaccuagcacagugccuggccugaagaaggcagau

SEQ ID NO: 2253166 - RNA, 63 nt, Homo sapiens
cugcauuugcacugagacucagcuuccaguucagugaggacagccgggcuaguguagaugcgg

SEQ ID NO: 2253167 - RNA, 91 nt, Homo sapiens
cacauaggauuccagagcacugcugcaggguucugaguguuuguccuucacauaacaauccagaacacugcugcuguguuccgagugugug

SEQ ID NO: 2253168 - RNA, 77 nt, Homo sapiens
cagacaacacagguucaaggcuuggcuaggcaacccugggugagucacuuagccccuuugagccucaacuguuucug

SEQ ID NO: 2253169 - RNA, 65 nt, Homo sapiens
gcucagccuugguuucuuguuagagcugauaucaaacuggcucacacugaaacuagggugugagu

SEQ ID NO: 2253170 - RNA, 60 nt, Homo sapiens
ggauggcaugugcugccaccaagguauccacacuuaguugccuagcacaugcugagcucc

SEQ ID NO: 2253171 - RNA, 69 nt, Homo sapiens
acaucuggcccuguguauauuucuacuguguacaugugaguauauguagguguacauacaugguuaugu

SEQ ID NO: 2253172 - RNA, 56 nt, Homo sapiens
guguucaaagcugauugagauuagauggauuuguuuauuaaaguuagcuuuagcau

SEQ ID NO: 2253173 - RNA, 58 nt, Homo sapiens
aaaggucagcugcacauaguggacacucagaguguugacuggagacuguugauccuuu

SEQ ID NO: 2253174 - RNA, 71 nt, Homo sapiens
gcauuacauagucaaggugucucauuucuaacaaauaccagaaauuacacuuguaaauggcauguaugugu

SEQ ID NO: 2253175 - RNA, 118 nt, Homo sapiens
uucaaauauguuucugcuacaaacauuguccuuuagaugguuccuuugcugccauuaugacuauggcguaaucuguaguaaagcaccauuaagauguuaauacagauguaugugugaa

SEQ ID NO: 2253176 - RNA, 130 nt, Homo sapiens
uggguuuaaaucccaccucuucuuauaauaucuucaaagugacaaaguugcagcaucuacugcauaggaaccaauaaugauaauguggcaacuuugucauuuuguaaaugaggguacugauacacaccua

SEQ ID NO: 2253177 - RNA, 76 nt, Homo sapiens
cugagcuuucagugagucauaaucuuuuugcugacggagggucuugcauggauguugauggcugcugacugaucag

SEQ ID NO: 2253178 - RNA, 64 nt, Homo sapiens
cauauaagucagauuauuugaaaauaugggucuaaauugaucauguuuccaguaaucuuaugug

SEQ ID NO: 2253179 - RNA, 78 nt, Homo sapiens
gccugggaugaauuagguauguuuaugaaucaucuuucauuucucaugggcuccauaccaaguugauccagaccaggc

SEQ ID NO: 2253180 - RNA, 78 nt, Homo sapiens
agcacaaugaucaaugcaugugacaaagaguaugaaucacuaggaauugcccuugucagugcauuagcuugaugugcu

SEQ ID NO: 2253181 - RNA, 107 nt, Homo sapiens
gaugggggucucacuaugcugcccaggcuggagugcaauggcuauucacagguggaaucaccaugcacuacagccuugaaauccugggcucaagugauccuccuguc

SEQ ID NO: 2253182 - RNA, 103 nt, Homo sapiens
caaauaugaaaugaaguggguuucaccaaauacaucuugggauaaaaacaaagucugucuuuagucccauaugauuuagugaaauucaugcaccacugguuug

SEQ ID NO: 2253183 - RNA, 118 nt, Homo sapiens
uccacuaaauuuggggaugauuuguuaugcagcaauugauaaucuauaccagaaguaauuuuuuucucugagaacuuaacuugcugcuagaaagucucaaugaugaauuuaaaaugga

SEQ ID NO: 2253184 - RNA, 65 nt, Homo sapiens
gccuuauuuuguaauugaaauguuuaaaaaauguuuuagauauguuuaguuucaaaaugauaggu

SEQ ID NO: 2253185 - RNA, 75 nt, Homo sapiens
uuuuaaaauuuaacagcuuuagaaauuuggggauuuaauucccaguggaauauaugaaugcuuuaaauauuagaa

SEQ ID NO: 2253186 - RNA, 99 nt, Homo sapiens
aaaaaguguuuccaacuuauugaguaaaaagaaugguucaucauuguaucucauggaguuaaaccuuucuuuugauugaacaauuuggaaacacuuuuu

SEQ ID NO: 2253187 - RNA, 58 nt, Homo sapiens
uuuggaaagggaggacccccuuugaguaccuaaugaaagcuguggguccucucccaaa

SEQ ID NO: 2253188 - RNA, 67 nt, Homo sapiens
ugaaaggagcaagacguaaaguagauggcgagagacaaugcuguuuagcgaaugcuugcuccuguca

SEQ ID NO: 2253189 - RNA, 57 nt, Homo sapiens
agucagaugaggucaucuaccugcaguaugugaaggugaauguaaagucaugugacu

SEQ ID NO: 2253190 - RNA, 66 nt, Homo sapiens
gggaauuucuuucaaguuuugacuuaaccccaguauugagccaaugauuugaauagagcagguccu

SEQ ID NO: 2253191 - RNA, 61 nt, Homo sapiens
uucaguagucuccauagaaccgugacuuacaauuuaccuagguucaauaaagacuacugaa

SEQ ID NO: 2253192 - RNA, 57 nt, Homo sapiens
guggagaaauaggaaugcuuuugcccuauuggugggaguguaaauuauuucaaccau

SEQ ID NO: 2253193 - RNA, 82 nt, Homo sapiens
agagccugugaauggaugugcagucagggagguuuuacaucaccaagauuccuaucccagaaacgcauauguucauagcucu

SEQ ID NO: 2253194 - RNA, 60 nt, Homo sapiens
acugugaucaugauccugaagcauuucuucaaagaauuguaauaggagaugaaucauggu

SEQ ID NO: 2253195 - RNA, 84 nt, Homo sapiens
uguguuuuguaauuagucauugcccccuggggugagguugggaguuuucaccggagguggguugaccagauuugcaaaaugaca

SEQ ID NO: 2253196 - RNA, 64 nt, Homo sapiens
aagcaauggcaauguaagucagaaaaauggaagugcuguuuuuggagaauuguauugccagcuu

SEQ ID NO: 2253197 - RNA, 89 nt, Homo sapiens
aucuuuacaaucagcagggugggcugaguuuagaggaugccagagacuggcaguguucaaaucaugcccaucuggguugauccuaggau

SEQ ID NO: 2253198 - RNA, 87 nt, Homo sapiens
aaaagaagagagaguuuuuaccagagaagacgagggggaaauuuuuucccugucuuccucucuuggaucucaauuuguucuuuuuuu

SEQ ID NO: 2253199 - RNA, 75 nt, Homo sapiens
ugaauaugugagcaugagagucauacaaauaaaaauccugaaagaaaaggaagaugacugaugcuuaaauauuca

SEQ ID NO: 2253200 - RNA, 115 nt, Homo sapiens
aaaauggcuuuuauauuuaauuuaugauugggaauaugauacaggucuuuuuucuguuugauugaaaugaccagcauuuucccuagucguuaaauauucuacaaaaguacauuuu

SEQ ID NO: 2253201 - RNA, 101 nt, Homo sapiens
acaggaggauuuugugggggcucgugucacugugaggauauuguaguaguaccagcugcuaugcccacagugacacagccccauucccaaagcccugcugu

SEQ ID NO: 2253202 - RNA, 55 nt, Homo sapiens
cuggggccccgggugguuauggauuacccagagccauagcaccagacagcccuag

SEQ ID NO: 2253203 - RNA, 75 nt, Homo sapiens
cauaguaagugguagggucaggauuggaacccagacuguuugacuccuaaacuugugcuuugaccauuuacugug

SEQ ID NO: 2253204 - RNA, 66 nt, Homo sapiens
uggagcaaaaugguccaguuagugcuguguagcacuguguaguaccacgugaugccauuuucccca

SEQ ID NO: 2253205 - RNA, 81 nt, Homo sapiens
uagguuaaaguuauugccccucaguuacacaauaauucagcaagacuggaaaucuguuauuuaggaaauaauuuuagcuug

SEQ ID NO: 2253206 - RNA, 70 nt, Homo sapiens
aagucuuugcuauugugaauagugccacaauaaacauacgugugcauaugucuuuauagcagcaugauuu

SEQ ID NO: 2253207 - RNA, 81 nt, Homo sapiens
aucuccuggucuggaagcaggugaugaguggguguggaaucuacauuugaguaucacuuguucaaccacaagaccauagau

SEQ ID NO: 2253208 - RNA, 77 nt, Homo sapiens
cucugggagcuuaagacaguuccaaucuuaccccacacuuccggggauccugauuuaacuggucuaggggcccaggg

SEQ ID NO: 2253209 - RNA, 76 nt, Homo sapiens
ucaccauucccauuugugaccaaaaucaacauaccuccccacauaggcaagguuugauuuuggucagggaauguga

SEQ ID NO: 2253210 - RNA, 68 nt, Homo sapiens
gccaccaggcccgcugcuaugguggcuguucccugcccuuaagucaccggcagacguggccugauggc

SEQ ID NO: 2253211 - RNA, 85 nt, Homo sapiens
agguauacaugugccauggugguuugccgcaccuaucaauccgucaucuagguuuuaagccccaugugcauuaaguguuuauccu

SEQ ID NO: 2253212 - RNA, 64 nt, Homo sapiens
gcuguagguguuaucagccuauuuaauuuguuauaaucuuauagauuaagugugauaucucagu

SEQ ID NO: 2253213 - RNA, 89 nt, Homo sapiens
aguuaccuggggaacgcaguacacuguugguaggaauguaaauuagugcaacugcuauggaaaauaguguggagguuccucaaaaaacu

SEQ ID NO: 2253214 - RNA, 60 nt, Homo sapiens
gaauccauguguacuccauguuuuccacuuauaagugagaacauacggcauuugguuuuc

SEQ ID NO: 2253215 - RNA, 105 nt, Homo sapiens
guguagccgcucauguccucuuucagugccuggaagucgugcuucaggucaugacccaccaccagcuugccuuucaggagcugcaggaucuggccaggaagacau

SEQ ID NO: 2253216 - RNA, 80 nt, Homo sapiens
agucacagauuaaugugucaaauuaauguauuuguguugguuaauauaaaugcuucuauguggcauguuuagucaagacu

SEQ ID NO: 2253217 - RNA, 79 nt, Homo sapiens
uggaaucaaauugucaaugaacggaauugaauggaaucauagaacggaauccaauguaaucaucauugaauugaaccca

SEQ ID NO: 2253218 - RNA, 77 nt, Homo sapiens
auagugcugcaaacaugagaggaagugcagauaccuaucucuuugauacaccaauuuccuuuccuuuggguauauau

SEQ ID NO: 2253219 - RNA, 74 nt, Homo sapiens
uagaugucccacaguauuccaauguuuagauauuccguagcucauuuaaacagucuucuccugagggacauuug

SEQ ID NO: 2253220 - RNA, 127 nt, Homo sapiens
gcacccccauagaguugugagcccuuaaaaaggacaggaauugcucagucagggagcucggcucuugagacaggagucuugccgaugcucccggcugaauaaaccgcuuccuucuuuaacucggugu

SEQ ID NO: 2253221 - RNA, 94 nt, Homo sapiens
aaaggguaauggggaaagcaacuguuacauaguaaacauugacuauuuguucaaaauccauggcuauucuguaaggguuaagucauugcucuuu

SEQ ID NO: 2253222 - RNA, 84 nt, Homo sapiens
cuggggagguugacugacgaccgcucuaccugcuuccugcugaaauggggcaugguagggguugugcaguugagauuuccucag

SEQ ID NO: 2253223 - RNA, 55 nt, Homo sapiens
gcccaggcuggagugcaguggcaugaucucagcucacugcacuugccuucugggu

SEQ ID NO: 2253224 - RNA, 129 nt, Homo sapiens
gguagauaagcuuuuugauaugcugcuggauucgguuugccaguauuuuauugaagauuuuugcacugauguucaucagggauauuggaccaagcagaccuaauagacaucuacagaacucuccacucc

SEQ ID NO: 2253225 - RNA, 58 nt, Homo sapiens
ugggaugaugaaaaggcuuucuguuuguuuuugagauggggucuugcucugucaccca

SEQ ID NO: 2253226 - RNA, 85 nt, Homo sapiens
ggucagagguuugcacauugcaccuuuuguaugguccaaguuaagaauauacacaaauucaugguuaauggugaauggcuuggcc

SEQ ID NO: 2253227 - RNA, 87 nt, Homo sapiens
ucaaaagacugucagauaauuugcauccaucuuuauugugccacacucuaguacguagaugucacuaugcaaauaucuuucuaauga

SEQ ID NO: 2253228 - RNA, 99 nt, Homo sapiens
ucaaauaggaaaagauuuuagucuuuucaguuugucaggauguaauaaaaaugcaaugaauagacacuaaagacuguauuuuuuaaaucuuuuuuuuga

SEQ ID NO: 2253229 - RNA, 60 nt, Homo sapiens
caggguuccugaccugggguagguaaagaaugucacuuucuaucaggcccaggagcccug

SEQ ID NO: 2253230 - RNA, 92 nt, Homo sapiens
cugguuguuuugugugguauuauaacuagguauccaagcuuguucaaaaaucauaucccaaugccugcaguuaugguucaccagauaaucag

SEQ ID NO: 2253231 - RNA, 56 nt, Homo sapiens
uucagaaaauggagaggcuagacaagaaaaugaugcuaaucucacccuuuucuggg

SEQ ID NO: 2253232 - RNA, 87 nt, Homo sapiens
gacucgccuugccauagaagauuuauggcuucuuccuuaccaggcauuuggugguaagaggcccugaguuuguauauugccagaguc

SEQ ID NO: 2253233 - RNA, 57 nt, Homo sapiens
gcaauauguuacaacacccccugaaaauagguuuuaggcaggauaguuacauauugu

SEQ ID NO: 2253234 - RNA, 62 nt, Homo sapiens
gggugugcaaaucucugaguaucuuuucaaauaaaggaaggaaauuaguuauuugccuaucu

SEQ ID NO: 2253235 - RNA, 76 nt, Homo sapiens
agcaauaaguuugagguguauuguacagcacaaugacuguaguuaaugacaauguauuauauucucaaaaaaugcu

SEQ ID NO: 2253236 - RNA, 99 nt, Homo sapiens
cucuuaaaggccccuauuuuuguacuguuucauuggagauuaaguuucaacauuaauuuuggaugagacagauauuaaaaccauaguaacaucugagag

SEQ ID NO: 2253237 - RNA, 121 nt, Homo sapiens
guuacuuuuuuuuuucauuuuuaggaaguacaucucagaaucuugauucuggaacagauuugucuuucccauggauucugaaugugcuuaauuuaaaagccuuugauuuuuacaaagugau

SEQ ID NO: 2253238 - RNA, 130 nt, Homo sapiens
uccaccugccucggccucccaaagugcugggauuacaggcaugagccacagugcuuggccuuaaaauuuuuuuuaaguagcugggcaugguggugcaugccuagcugcuugggagucugaggcaggagga

SEQ ID NO: 2253239 - RNA, 107 nt, Homo sapiens
guucuuugaugacuugacuucugacagugcuuggcaugcaguaggaguucuaggaauacguaucaauuucacugcaugaaaaggacagcaggaugcugaggaaggac

SEQ ID NO: 2253240 - RNA, 56 nt, Homo sapiens
agugaguucuuccuaucucugccuaacagaaugggcaaugcuaugaagagcuaacu

SEQ ID NO: 2253241 - RNA, 67 nt, Homo sapiens
guugucguugugucauucuuaaaauggcugcaucuuauugcagugcauagaugugccacauuuuaau

SEQ ID NO: 2253242 - RNA, 77 nt, Homo sapiens
ucaucaaaugucaaagguaggcaguaucacuugggaaguccaagucacagccuuuuacuuuagagaugaaaagaugg

SEQ ID NO: 2253243 - RNA, 80 nt, Homo sapiens
auuucaagggugucuguugcuucaggaaacaguaacggagcaggccuugcuggugguucgagcaacacccaccccgaaau

SEQ ID NO: 2253244 - RNA, 93 nt, Homo sapiens
auuucucuugaacugagggccaucccaggcauuguccaugcugaaggggugcuuucagcccauaguguuugagccuaaucacaguggagaaau

SEQ ID NO: 2253245 - RNA, 82 nt, Homo sapiens
aagagacggggucuugcuauguugcccagucuggagugcaguggcuauucacaggugcaaucauagcauacuacagucuuuu

SEQ ID NO: 2253246 - RNA, 64 nt, Homo sapiens
ccaauagcacaugucagguaauuugccaaugauucauugcagugacagguuaugguguuauugg

SEQ ID NO: 2253247 - RNA, 99 nt, Homo sapiens
cuacugucucuuggcuuccaugaacacugugcggcuuccuguggcuccucugaaggaagucugcaguuuucuuuggcugcuguaaugcuuugacuuuag

SEQ ID NO: 2253248 - RNA, 62 nt, Homo sapiens
ugaggaacuagcuacccuaauaggaaggacuugucuugcaacuaggucuggcuggcuuuuca

SEQ ID NO: 2253249 - RNA, 67 nt, Homo sapiens
guguaagcauugaaagagauaaagccuuuuuuuaaaagagguguuaaagucucuuuuaaucuuauau

SEQ ID NO: 2253250 - RNA, 94 nt, Homo sapiens
agucaaacuugagguuuauggaggagguaggaauugugcuaggacugaagcauuuggaccugggcucaaguccugccuccuucucauaauggcu

SEQ ID NO: 2253251 - RNA, 78 nt, Homo sapiens
uguaugugugguuuaagaauugaauucuggaaagauaccggaauugcauaaacacauuucuuaugaccugcguauaca

SEQ ID NO: 2253252 - RNA, 64 nt, Homo sapiens
agaaccuucuauugguaauauuuucugugaugaaaaucaaagauauauuuuaguagaguguuuu

SEQ ID NO: 2253253 - RNA, 81 nt, Homo sapiens
guuacccguaugucaauaagaaaauuguggcuuaugcauucaaauguaugcacuguuuucuugaugagauauauacguaau

SEQ ID NO: 2253254 - RNA, 83 nt, Homo sapiens
caucucugaguuuaaugcuacacuuuuggaagacaggacuuuuaauuaugucccuuccagguuuugugaguuuaaaugagaug

SEQ ID NO: 2253255 - RNA, 77 nt, Homo sapiens
gucagaugaauagucugcaaguauuucuaucccguucuguggguugucucuuuacuuuguagauuguuuccuuugac

SEQ ID NO: 2253256 - RNA, 93 nt, Homo sapiens
gggauuacaggcaugagcuacuacacccagcuuggguuuuuaagauuaaauauaugacuucagccaggcgugguggcucacgccuguaauccc

SEQ ID NO: 2253257 - RNA, 70 nt, Homo sapiens
ucguagauggcucuuauuauuuugagguaugauccuuccaugccuaguguguugagaguuuuuaucauga

SEQ ID NO: 2253258 - RNA, 105 nt, Homo sapiens
gauaaagguccaauuguccaauuugcauggagauauacaguuuuuccaguaccguuuauugaagagacuguccuuuccccauuguguauucuuggcacccuuguc

SEQ ID NO: 2253259 - RNA, 84 nt, Homo sapiens
caagaucagguaaaggcacuagaaguuaccuuuuuuguggacgcuuaagaaaggugacuggagaggccccaaaaauucaucuug

SEQ ID NO: 2253260 - RNA, 61 nt, Homo sapiens
ugguguagguuucgccucugagucuuagggcccuagagccucagcaguggauuuaccacca

SEQ ID NO: 2253261 - RNA, 82 nt, Homo sapiens
gacaggauuccaguacaggucucucauuuccuucaugauuaggaauacuacuuugaaaugagagaccuguacuguaucuguu

SEQ ID NO: 2253262 - RNA, 93 nt, Homo sapiens
ggaucagugacccauuugugaguaagccagaugaauugauuuugccugugccagaagaggaucaacugcuugagaucacaaaugacaguggcc

SEQ ID NO: 2253263 - RNA, 99 nt, Homo sapiens
caucaaagcagaaaaucggcaguguaauaauuuauuaaugacucagggucgucacuguggaaguuggguauuauacagugcagugauuuuugauugaug

SEQ ID NO: 2253264 - RNA, 73 nt, Homo sapiens
auuuggcaauauuauuaacccucugucuuaagauacaaggaaagcagccaggggauaauauugugucccaagu

SEQ ID NO: 2253265 - RNA, 95 nt, Homo sapiens
aggcaacacauauuuuaaugcauauguuuggguguguauaugugugugugcauauguauauauguaaauauaugagaaaaugugauuuacugucu

SEQ ID NO: 2253266 - RNA, 73 nt, Homo sapiens
auuuguaaacaaagaugaugucauuugaacagacuccaaauucaguuuacaaguggcaucucucuggacagau

SEQ ID NO: 2253267 - RNA, 82 nt, Homo sapiens
gucuuccaagugguucuaugaguuugcaacaguacauaagucuucuuugcaauacagucaugcagcaacugguuuauaagac

SEQ ID NO: 2253268 - RNA, 69 nt, Homo sapiens
gcauccaugugaagagaccaccaaacaggcuuugugugagcaacauggcuguuuauuucaccugggugc

SEQ ID NO: 2253269 - RNA, 59 nt, Homo sapiens
uguauuuucaacuuacaauggguuuaucaggauguaagcccauuguaaguugaggagca

SEQ ID NO: 2253270 - RNA, 66 nt, Homo sapiens
cugugauagguuagucaugaauuugcaguuaaugaagggcuauuuauuucaugccuacccucacag

SEQ ID NO: 2253271 - RNA, 68 nt, Homo sapiens
gagauggagucuugcuauguugccaaggcuggucucaaacuccuggccucaaguaauacuccugucuu

SEQ ID NO: 2253272 - RNA, 61 nt, Homo sapiens
ugaagacauuuuuggguguguagucuuccccaucucacucaacacucuucauaugucuuca

SEQ ID NO: 2253273 - RNA, 74 nt, Homo sapiens
augcuuguuuagagacuggaauuaaacaugcacuucuccuccaagcuuugcuuuaucagucucugaaaaagcau

SEQ ID NO: 2253274 - RNA, 66 nt, Homo sapiens
guguagccuaaguguacaguguuuauaaagucuacaguaguauacaguaaugucuuaggcugucac

SEQ ID NO: 2253275 - RNA, 76 nt, Homo sapiens
ugucuuuaucagcagcaugaaaacaggcuaauacaguaacuugguaacaguagaguggggugcugcugaaaagaua

SEQ ID NO: 2253276 - RNA, 65 nt, Homo sapiens
auguuggucuuaguaauacugugugcauccuugauacacugcaguggaagauuaagaagaaaugu

SEQ ID NO: 2253277 - RNA, 95 nt, Homo sapiens
gaaagagcaauuugagaacaaagcuacuuucccuucauucuaauaccaugagaauucaacauaugggguaguuacuguuguucuuuuguucuuuu

SEQ ID NO: 2253278 - RNA, 59 nt, Homo sapiens
guggagcuggugccaggcaagugcuuccaacuacacucccugaguacaacccacuccac

SEQ ID NO: 2253279 - RNA, 62 nt, Homo sapiens
gugagaugauggguauguuaauuugcuuuacuauaguaaucauuugacuaucuauaucucau

SEQ ID NO: 2253280 - RNA, 62 nt, Homo sapiens
uguugggcauugggcuaaacucccucagggagcaccaaggggagcagaagagaugcccagca

SEQ ID NO: 2253281 - RNA, 62 nt, Homo sapiens
ccugagacaucugagauuuuaagcagcacccucuuugcucugaaugugcuagugucucaagg

SEQ ID NO: 2253282 - RNA, 81 nt, Homo sapiens
uguuuauucauauaagugauguuauugggugacuccaaacacaugguucuccuacagaugauaucaccuaaaugccaaaca

SEQ ID NO: 2253283 - RNA, 84 nt, Homo sapiens
gccaaucuacaauagugauguuauccacagaaguaauugggaaaguugcauaucuuguggaauaucucuggaauaagggcuggu

SEQ ID NO: 2253284 - RNA, 75 nt, Homo sapiens
aggggcguccugagugaggcugggcagucccuugggccacguccucccagagcccgcccagcuucaccagccccu

SEQ ID NO: 2253285 - RNA, 89 nt, Homo sapiens
ggaugaucagaaaggagaucaguaguaagauggaggaacaccagggaaagaucaucuugccacuucauccccuuuccagcuccccaucc

SEQ ID NO: 2253286 - RNA, 79 nt, Homo sapiens
cguugacugccaacccgugcagagcgcuuagugcguguccgaccgugagcugagcgcugugaugcgggugcuguuaaug

SEQ ID NO: 2253287 - RNA, 59 nt, Homo sapiens
guuugagcaggcagcauggcagcaaagacccaaauguagaaugcugguguugcucaaac

SEQ ID NO: 2253288 - RNA, 59 nt, Homo sapiens
cuaaauuuuuccuuacuuucuguugaauaauaguauuuggaauuuagggaaugauuuag

SEQ ID NO: 2253289 - RNA, 76 nt, Homo sapiens
ucaauugguaguagcugcuuggaauucuguguuggcuuaucuucauucaggagaaaggaagacuaugaucaauugg

SEQ ID NO: 2253290 - RNA, 79 nt, Homo sapiens
ccaugaucagaugguggcaagagccaagucuucucacauaaagagaaaucacauugaaucugcuaccuacgaccacugg

SEQ ID NO: 2253291 - RNA, 79 nt, Homo sapiens
acguggauggacaucagauguaguauuuuagugaaagaagccuaucuggaaaggcuacauacugcaucaccaucuaugu

SEQ ID NO: 2253292 - RNA, 70 nt, Homo sapiens
uuuguacuugaaacccagggcccugguggucuaggcacccaagggaaucuccuggucuucagguugcaaa

SEQ ID NO: 2253293 - RNA, 70 nt, Homo sapiens
ucacuugaaccuaggagguugcagugagcugagaucaugccauugcacuucagccuaggugacagaguga

SEQ ID NO: 2253294 - RNA, 56 nt, Homo sapiens
gaaguggaauugguaagcccaagaauauagucauugguugcaccaguuuacacuuc

SEQ ID NO: 2253295 - RNA, 73 nt, Homo sapiens
aggcuggaguacaguggcuugaucucggcucacugcaaccuccgccuccccgguucaagcuauucuccugccu

SEQ ID NO: 2253296 - RNA, 62 nt, Homo sapiens
uugagaugauguuacucuuuuuccuugguguuuuccuaaggaagccuugugacauaucucag

SEQ ID NO: 2253297 - RNA, 84 nt, Homo sapiens
ggagaaucacuugaacccgggagguggagguugcagugagccgagauugcaccauugucaccugggugacaagagugaaacucc

SEQ ID NO: 2253298 - RNA, 76 nt, Homo sapiens
ucacuugaaccugggaggcagagguugcagugagccgagauugcacuguugcacuccagccuaggugacagaguga

SEQ ID NO: 2253299 - RNA, 93 nt, Homo sapiens
uuccuauugcuccuuuuguugcuauuuagcaccugugcacaccaggcauuagucggugcauugggagucagugcugaacaaaggggguaggag

SEQ ID NO: 2253300 - RNA, 72 nt, Homo sapiens
auacuauuagguuggugcaagaauuauugcuguuuuuguaucacaguuacuuuugcaccauccuaauaguau

SEQ ID NO: 2253301 - RNA, 100 nt, Homo sapiens
aagaaaacaaaagaaagaaagaaacaagggauuugggcuuugggaucaagaagaccuggguuuggcucuuguuucugucaauuauuuccuuuaauuuuuu

SEQ ID NO: 2253302 - RNA, 107 nt, Homo sapiens
cuaaggccauaggguucuguagggucacuugccuaaucugcaugauuuuucagugggaaggguaauguuggguuagguguuauuacuggcagcagcucuauacuuag

SEQ ID NO: 2253303 - RNA, 73 nt, Homo sapiens
accaguaacagucucaacaguggucugaauccauucaugagaacaacaaucccacuugugaugcuguacuggu

SEQ ID NO: 2253304 - RNA, 84 nt, Homo sapiens
ggagcaaauggucaggaccucgguggcauucucccucucucucaaggacaggagggugaccaucugggccuuggccagaguucc

SEQ ID NO: 2253305 - RNA, 61 nt, Homo sapiens
ucagugcaggaaucucuagccaaaucuuaagaaacaccauggcuggcaaaacugcaacuga

SEQ ID NO: 2253306 - RNA, 61 nt, Homo sapiens
gauuuuaggguuggaucuuuauuaauauguaauaucuaugagguauccaagcccagaaauc

SEQ ID NO: 2253307 - RNA, 67 nt, Homo sapiens
ccuggaucaugugucucagcccagaccuauuugugugucuuaacguaaagcugugacugaugcuagg

SEQ ID NO: 2253308 - RNA, 59 nt, Homo sapiens
ugucuuaauauggaguuacucagaugaaguuaaaucuguguaaguccugaguuuggaua

SEQ ID NO: 2253309 - RNA, 90 nt, Homo sapiens
ggucccaagauaaacuuggagcuccugggccuguuagaaagugacauucuuuacugacuacaggucaggaagcuguagucuacagggacu

SEQ ID NO: 2253310 - RNA, 78 nt, Homo sapiens
gcagccauuguucuauccaaauuggguaucuguuaaccauuugaaagguauagguucuggaggcuuaacaauggcugc

SEQ ID NO: 2253311 - RNA, 66 nt, Homo sapiens
ccacaaagugcaguccuucucacucuuccuuucuuuuucuagagucaguggagccucacucugugg

SEQ ID NO: 2253312 - RNA, 67 nt, Homo sapiens
gccuucccacauucuuuacauucauaagguuuuccaccaguaugaauuuucugauguuggguaaggu

SEQ ID NO: 2253313 - RNA, 61 nt, Homo sapiens
gucccugugucuuuauguggccauuuuccucuaaggacaccagucacaccagauuaggggc

SEQ ID NO: 2253314 - RNA, 73 nt, Homo sapiens
gagagaaggaagcuagcauuuguucagugacaaaucuaugucaagugcuuuacaaauuuuagcuuauugucuu

SEQ ID NO: 2253315 - RNA, 79 nt, Homo sapiens
acguaaaaacagcagccuagaaucuggcacuuaguuguucgucacugaaauguguuaucugggccugcuaacuugacgu

SEQ ID NO: 2253316 - RNA, 73 nt, Homo sapiens
gcgaccggccugacauccccaguuuuaaagcuaguucucuguagucuuauuaagcuaguugucagugcuuugu

SEQ ID NO: 2253317 - RNA, 79 nt, Homo sapiens
acauuuuagcaccaaacauauacucagucagcaccagagacugcucacuagagaagaguguuaugugugcugugaaugu

SEQ ID NO: 2253318 - RNA, 63 nt, Homo sapiens
auggaauguauagucauguagguuaacuuugugaguauacuguuuaaugucuguacagucuau

SEQ ID NO: 2253319 - RNA, 55 nt, Homo sapiens
agagcauucuuggcugauugaugggaaguuccagcaaucagcacaagugugcuuu

SEQ ID NO: 2253320 - RNA, 91 nt, Homo sapiens
uaagccaauauuuccgauauggauguuaagguucacagcacaacaaacaucacaaccuguggcugucuuuuaccucauucauggaggcuua

SEQ ID NO: 2253321 - RNA, 79 nt, Homo sapiens
ggugaaaaugaaggguguaaaaugguacaacccguuuguaaaccaguuggguaguuucuuacaacucugcaauuucacu

SEQ ID NO: 2253322 - RNA, 109 nt, Homo sapiens
guuuugcacagcacaacucuagagggugcuauuuauguugugauuugcugcaccuuucccacauugcauauggcacccucuucaauugagcaguugugaucugcagagc

SEQ ID NO: 2253323 - RNA, 93 nt, Homo sapiens
gcucaaagggcucuggccucauccccugauaccaaccaccaugggguuaauccuggggucggugaauuagggaaagccagguagccucugggc

SEQ ID NO: 2253324 - RNA, 65 nt, Homo sapiens
ggugaaucugacaauuaugugccuugggguugcucuucucgaggaguaucuuugugguguucucu

SEQ ID NO: 2253325 - RNA, 81 nt, Homo sapiens
ugccccuauuugaccagagggcuacuuaaaggauggagcugauucucauugguuggacaguucucucuucagacaggggua

SEQ ID NO: 2253326 - RNA, 95 nt, Homo sapiens
cauugacucuuuagucucaauuguuggucugcaugucuacugauaagccgguacugugcuguuuuaauuauugaggcuuucuagauguuguagug

SEQ ID NO: 2253327 - RNA, 104 nt, Homo sapiens
gugguggugggugccuguaaucucagcuacucaggaggcugaggcaggagaaucgcuugagccugggaggcagagguugcacugaaccaagaucgcuccaccac

SEQ ID NO: 2253328 - RNA, 72 nt, Homo sapiens
ugacagccuuaugaggcaagucaauuucuuacuacuuccaucacuuaagagauuguguucauaggcauguua

SEQ ID NO: 2253329 - RNA, 88 nt, Homo sapiens
uagggaguuuacauccacccauuauugaugcaacagcccuuaauagcaccuuuguugucagaggguguuguguugcuuaauaucccua

SEQ ID NO: 2253330 - RNA, 72 nt, Homo sapiens
ggugguucgaguguaguaggccauaugaacuucauaugauugguuuuuugugauggcauuacauuuaucauc

SEQ ID NO: 2253331 - RNA, 59 nt, Homo sapiens
gggaagggcucaucagguggccgcucugccuugaagagugguacccucaggcccuuuuc

SEQ ID NO: 2253332 - RNA, 88 nt, Homo sapiens
ucucuuagcugggcaauuuucucuacagggaaaccgccccucaucaauuauuuguuuacccugaaggaaaguauguuuacaaaaggga

SEQ ID NO: 2253333 - RNA, 71 nt, Homo sapiens
ccauugggaguuggaggauagagucauguauugauaguuaauuuaguugaguuccuuucccaguccagugg

SEQ ID NO: 2253334 - RNA, 59 nt, Homo sapiens
guuuuugggaaggaggagaauuauauguauauagagcugauaucuuuauucccaagagc

SEQ ID NO: 2253335 - RNA, 64 nt, Homo sapiens
cagauauagcuaugggauguauuugcaagacagaacuuagcugaacuugcauagcuguuuccug

SEQ ID NO: 2253336 - RNA, 92 nt, Homo sapiens
cucagagauggugauauggauuucauuagacuugaguuacaguuugguuguagacucaagacugcaugaauucugugugugcuguuccuggg

SEQ ID NO: 2253337 - RNA, 103 nt, Homo sapiens
gauaaggcuuugccuuaagggaauguuguggcugguuggauguuuuauccagaccacuaaaacuuucuccauaucaccaauaaggcugcuuugcuuucuuauc

SEQ ID NO: 2253338 - RNA, 129 nt, Homo sapiens
ucaugguggauaaguuuuuugauaugcuguuggauuugguuugccaguauuuuauugaggauuuucgcaucaaaguucaucagggauauuggccugaaauuauuuugucguuguugugucucugccagg

SEQ ID NO: 2253339 - RNA, 64 nt, Homo sapiens
uucgguuugccaguauuuuauugaggauuuuuguauugauguucaucaaggauacuggccugaa

SEQ ID NO: 2253340 - RNA, 71 nt, Homo sapiens
cacugcaguguaauuaagguugcuaaucaguugacuuuaaauugaagaaauaauccuaaauuaucugagug

SEQ ID NO: 2253341 - RNA, 60 nt, Homo sapiens
uaugaaauaguagguuuggagagugugcagccccacauuaucaaggccacucauuuuaug

SEQ ID NO: 2253342 - RNA, 79 nt, Homo sapiens
cucuuugguuucugucucuguaaaaaaaagugucuaauugcauuugggcaaaaaacuugcagugaagagagaaaaagag

SEQ ID NO: 2253343 - RNA, 79 nt, Homo sapiens
uauauuaaucugguagucaucaaaguauaaaugauguuuaaaaccauaagacuauaugagauuacccagaaagaguaua

SEQ ID NO: 2253344 - RNA, 89 nt, Homo sapiens
ggagaauugcuggaaccuaggagguggaguuuguggugagcugagaucaugccaucgcacuccagcuugggcaacaacagcaaaacucc

SEQ ID NO: 2253345 - RNA, 88 nt, Homo sapiens
ggagucucgcuguauugccuaggcuggagugcaguggcucaaucucggcucacugcaaucucugccucccagguucaagcgauucucc

SEQ ID NO: 2253346 - RNA, 107 nt, Homo sapiens
gaguguguguguguacauuugaauuucccauaaagguguuuuuuauuagauaggguguagcuuuguacuagucauauuuugaaauucagaucugcucauauacacuc

SEQ ID NO: 2253347 - RNA, 101 nt, Homo sapiens
ggggauauggcagugaacagcacaaaaguuguuucugcuuguggaggucacauuucagugagacgaaaacaacaaagugugugugugcaucccugcccccc

SEQ ID NO: 2253348 - RNA, 80 nt, Homo sapiens
ggucuuaacagaagacucagcaucuguucuugagcuggcucauagcagcuaacaggguguuugcaguuucuucuaagacu

SEQ ID NO: 2253349 - RNA, 64 nt, Homo sapiens
augagauuugggagggccgggagcagaaugauaugauuuugcuauguccccacccaaaucucau

SEQ ID NO: 2253350 - RNA, 98 nt, Homo sapiens
gaggcaggagaauugcuugaacccagaggcagagguugcagugagccgagaucaugccauugcacucuagccuuggcgacagaaugagacuccgucuc

SEQ ID NO: 2253351 - RNA, 72 nt, Homo sapiens
caccccuggggcucacgcugcgccaggaugccgcugcuggcauccaccgugggcugcggggcucccgcggug

SEQ ID NO: 2253352 - RNA, 94 nt, Homo sapiens
uccagaugggcaaauguuggaaauuccuugauuaggauucaguucuauugcugcucaauggggauuuucaugacuuuuggcuccauucucugga

SEQ ID NO: 2253353 - RNA, 78 nt, Homo sapiens
uuuucccuuucagagguagagaguuuugauucugucucuuucacagcagcaagagaucuuugccugugcccuggaaaa

SEQ ID NO: 2253354 - RNA, 64 nt, Homo sapiens
augacccccauuucuggagcuaauccuggaauuaacauuacccuuagacuccagagugggucau

SEQ ID NO: 2253355 - RNA, 63 nt, Homo sapiens
ucucugugguuuuccagaaauuuauuacugacauuauaaggcuuucugggggagcauggcagg

SEQ ID NO: 2253356 - RNA, 80 nt, Homo sapiens
ugcaaagauguccaagauauauuaaauacaaacaaaaaguaaguuacguauguuauguauggagugaucccauuuuugua

SEQ ID NO: 2253357 - RNA, 82 nt, Homo sapiens
gugauauaauagcuuaugcuuggaagagaugaucuuuuuaagaacaccagaucacuuaagcauuaaagcucaagaauauuau

SEQ ID NO: 2253358 - RNA, 82 nt, Homo sapiens
augugcacagugguuaauggcacagacucuuggucaaguugugcaacuuugcccugagucugagcccucucuucugugacau

SEQ ID NO: 2253359 - RNA, 58 nt, Homo sapiens
gacaauaucccauggcagagaucgccagcauuaaggccauucauggugguacguuguc

SEQ ID NO: 2253360 - RNA, 62 nt, Homo sapiens
guggagcgcccaucuggcaaucccagcuccagagcccuagugggaucagcugggcucucugu

SEQ ID NO: 2253361 - RNA, 113 nt, Homo sapiens
aaguccaugcucuuugccucaguugaaggagccagaauaugcaucccaacuauaggcaaggccacugagaugcauauucuggcuccuucaacugaggcaauaagcauggacuu

SEQ ID NO: 2253362 - RNA, 55 nt, Homo sapiens
ggggcucuagguaaagcaacauagcaacuacuaugugaugcagggccugggccuc

SEQ ID NO: 2253363 - RNA, 72 nt, Homo sapiens
auuccuguaaucccaacacuuuaggaggcugaggcugaggcugaggugggaggauuacuugaagucaggagu

SEQ ID NO: 2253364 - RNA, 58 nt, Homo sapiens
gugagcgauacagaggaacugggaggcaauguuucccacaguggccucauauccuuac

SEQ ID NO: 2253365 - RNA, 76 nt, Homo sapiens
gucaauggaagacaugcaagcacacaagaggaaauguguacacaucauuucaugcuucugcuugccuucaugugac

SEQ ID NO: 2253366 - RNA, 69 nt, Homo sapiens
uuggaaugagaaauauuacacaauugcacugguuuucaugggcuauugucagauauaucucuauucuga

SEQ ID NO: 2253367 - RNA, 74 nt, Homo sapiens
ccucacucuugccuuucuuccuugcuguaacuucugucuugacauagauagcaggaaaggggucagaucugggg

SEQ ID NO: 2253368 - RNA, 75 nt, Homo sapiens
uguguaucacaauggcacuauuggaaaagguaguggcauaccuuuuaauaugcggugcuauaagugcuaugcaua

SEQ ID NO: 2253369 - RNA, 60 nt, Homo sapiens
gaacuggaagaauagaaugcuguggccagagagugaggauggaaucuauuauuccaguuu

SEQ ID NO: 2253370 - RNA, 70 nt, Homo sapiens
guucuguuccucuagagaaccuggacuaauauagauuuugguaccaguaaugguucuagaggaacagaau

SEQ ID NO: 2253371 - RNA, 64 nt, Homo sapiens
gaauaucccaaagaugaaauaacugcuuagagaaacagcaaguucucugucacuggggguauuc

SEQ ID NO: 2253372 - RNA, 77 nt, Homo sapiens
ugcgcguccaugugaagagaccaccaaacaggcuuugugugagcaacauggcuguuuauuucaccuggaugcaggcg

SEQ ID NO: 2253373 - RNA, 68 nt, Homo sapiens
uuuauggaaaucuuaccuuauggucaaacugauuaagaucggauagauuauauauaagguuuuaugaa

SEQ ID NO: 2253374 - RNA, 70 nt, Homo sapiens
ucauauauggcuuuuauuguguugagguauguuccuucuauauccagcuuuuugaggguuuuuaucauga

SEQ ID NO: 2253375 - RNA, 81 nt, Homo sapiens
uugccauguucauuacagcaucauuuacaauggccaagauauggaaccaaccuaaaugacugucaguagaugaauggguaa

SEQ ID NO: 2253376 - RNA, 77 nt, Homo sapiens
ccugcuguugaugguguccuguuuccccaggauggaugacauccagcucugcaaggacaucauggacuugaagcagg

SEQ ID NO: 2253377 - RNA, 101 nt, Homo sapiens
gaguagcugggauuaaagcgugugccaccauguccggcuaauuucuuuguauuuuuaguagagauggguuuucacauguuggccaggcuggucucgaacuc

SEQ ID NO: 2253378 - RNA, 78 nt, Homo sapiens
gugaugacaucacaggaagaggcacggucccucugaugacgucauagggcaaggcaccuucucuggugauggcaucac

SEQ ID NO: 2253379 - RNA, 84 nt, Homo sapiens
gcugacacuccugaucacuacaccaaaauguguuaccaucauuacagcaugugcuuuuggugagagauuucaauagccuucagc

SEQ ID NO: 2253380 - RNA, 83 nt, Homo sapiens
cuaaggccuugaagaaaaauugcaugucugcuucuccuccucuccgcaagaagaaagcauuagacaggcauucaaguccuuag

SEQ ID NO: 2253381 - RNA, 89 nt, Homo sapiens
aaggcaaagaggcauugaaauauugcuuaucauuaauaucauuauuauuuaauagaggaaaaugagggauauacauguccucuuuccuu

SEQ ID NO: 2253382 - RNA, 128 nt, Homo sapiens
auuuugaaucuaaucccuuucuagcucaucuuuuauauuuugacuuuuauguauacauuuuuucauugcccauguucauggaguuuaaauuguaguggggagucacacaguaaacaaguaaauaaaau

SEQ ID NO: 2253383 - RNA, 67 nt, Homo sapiens
gagaugagcucauaaagagugauuuggggugcucuccucauaccaggcauucucgugaacuccucuc

SEQ ID NO: 2253384 - RNA, 86 nt, Homo sapiens
auccuuucccaaauaagaaggcaugaguucagaggguaugauuuucuauccaucuugauugugcuguuuuaaaaccagaaagugau

SEQ ID NO: 2253385 - RNA, 67 nt, Homo sapiens
cuuccauauucuaggacaggcugacaggcgaucacaaccaaaguugccaguccuggguauggggaag

SEQ ID NO: 2253386 - RNA, 78 nt, Homo sapiens
gccugccguucagcaggggcuucaauggucuugcucaaaucacaugugcgcugaugaauguccuuguugacuguaggu

SEQ ID NO: 2253387 - RNA, 129 nt, Homo sapiens
agaaaauaaaguaucaagguaacaauuagcaugaugacuggaacagcaauuuacauucacuguuaauauuaagauguaaagugccguuccagucaucaugcuaauuguuaccuugauacuuuauuuucu

SEQ ID NO: 2253388 - RNA, 67 nt, Homo sapiens
auaugugacugauggagaauaugugauugauggagaacuccugaacauuaguccuauagucacauau

SEQ ID NO: 2253389 - RNA, 106 nt, Homo sapiens
ugagauggagucucacucuguugccuaggcuggagugcaguggcgcgacgcgaucucggcucacugcaaccucugccucccagguucaaacgauucuccugccuca

SEQ ID NO: 2253390 - RNA, 74 nt, Homo sapiens
guuguauguggauuuuucaacugcauggggguugacaccccuaaucccuguguuguucaaggaucugcuauaau

SEQ ID NO: 2253391 - RNA, 58 nt, Homo sapiens
ggauucaucaagggguggaaguggaaguggcaccacucaccaucaccccuagagaucc

SEQ ID NO: 2253392 - RNA, 77 nt, Homo sapiens
ucuucucuuuuuauuguuuacuuaauguuauguuuucuuuuaaaucuagucaagugaagcagugggaguagagaaga

SEQ ID NO: 2253393 - RNA, 100 nt, Homo sapiens
ggaguguucagauuucggauuuuuucagauuguggaauauuuguauuguaguuaucaguugaguauuugcagucugaacaucugaaauccaaaacacucc

SEQ ID NO: 2253394 - RNA, 86 nt, Homo sapiens
ggcacaagguaggcacccgguuagggggcaguggauauucuuauuaaagaacauugcaaaugcucccuguggaugugaauugugcc

SEQ ID NO: 2253395 - RNA, 81 nt, Homo sapiens
uuccaacuguuauucucaauaauucguguuucuuugguacaaagaguacuguaaaaugcaguugguggggauaugcuggag

SEQ ID NO: 2253396 - RNA, 63 nt, Homo sapiens
aaagcugacuagcauuuagugcuguaaacauuuucaaaagcauaaagcuagaaccuuagcuuu

SEQ ID NO: 2253397 - RNA, 57 nt, Homo sapiens
ugagaugaggucucgcucugucacccaggcuggagacaguggugugauuucggcuca

SEQ ID NO: 2253398 - RNA, 62 nt, Homo sapiens
uugaaagcuaucagagauuccauaauguaaugaugagcaaucuggacucugaaagcuaucag

SEQ ID NO: 2253399 - RNA, 77 nt, Homo sapiens
gugucuccuguggagcuauguaacaguuuccuugggucauaacauuagcagugggauugcugggucugaggagacac

SEQ ID NO: 2253400 - RNA, 59 nt, Homo sapiens
uguuaucucugauuauugcauuucauuaguuuauuagugagauggaccaugagaaaaca

SEQ ID NO: 2253401 - RNA, 74 nt, Homo sapiens
uuccauaucguuaaaguucugacauucuaaucggaaaagaaaugaaccagcagacuuugacagguuuugugggg

SEQ ID NO: 2253402 - RNA, 65 nt, Homo sapiens
ggggaggcugggagccugagugguagugugcuuagggccaugagcuauggagcucccaccuucuc

SEQ ID NO: 2253403 - RNA, 76 nt, Homo sapiens
uuaccacuuucagguccagucacuggucugcaguaaccauuuugugcaagacacuguccugggcaugaagggguga

SEQ ID NO: 2253404 - RNA, 97 nt, Homo sapiens
cuggccaccggcccugcagccaggcgguguugauggcccccacagcuguggccacacgugugcccagccaucagccuccggacaggcggguggccag

SEQ ID NO: 2253405 - RNA, 66 nt, Homo sapiens
uagauucccucuucuggacccaaggacccaaguggggauucuuugggauauucugaaagggaacua

SEQ ID NO: 2253406 - RNA, 85 nt, Homo sapiens
ucuuauuuucuguagugccuaccacagcuucagacauuccuugggaacugcucuaauguggugggaggcugcacagacaguggga

SEQ ID NO: 2253407 - RNA, 109 nt, Homo sapiens
gccucauccccugcaaaagcuggcacagagaaggugcuuggugaaugcauuucuugaagugaguuaaagccaccauucuugcagccuagauuuuguuucuaggaagggc

SEQ ID NO: 2253408 - RNA, 70 nt, Homo sapiens
auuauuuuggcucugucuguaucuuugcucuauuccuauuugagcaaagacagagagaagccagaacaau

SEQ ID NO: 2253409 - RNA, 62 nt, Homo sapiens
uuaauuuaggaauggcagagaccagaugauauaugagucugguuuaagacaugcugaauuga

SEQ ID NO: 2253410 - RNA, 75 nt, Homo sapiens
agaguauauauaauugggauauuuguaacacaaaguaaugauaaaugcuuuggugauagauaccccauauacucu

SEQ ID NO: 2253411 - RNA, 78 nt, Homo sapiens
ugcuauugugaauagugcugcaauaaacauacgugugcaugugucuuuacagcagcaugauuuauaauccuuugagua

SEQ ID NO: 2253412 - RNA, 75 nt, Homo sapiens
cacucacuauggcagagucagaaagucaggcugcaguggccuggaccugcuuugacugcugccagaaagagagug

SEQ ID NO: 2253413 - RNA, 69 nt, Homo sapiens
cuugaacccgggggguggagguugcagugagccgagaucgcgccauugcacuccauccugggcaacaag

SEQ ID NO: 2253414 - RNA, 82 nt, Homo sapiens
aauccgugcuccuuaaguaguuguggaaugaaugaacagaaaacaagauucauagucacugcuacuuacauauggagggguu

SEQ ID NO: 2253415 - RNA, 85 nt, Homo sapiens
ugcaacaucucuucuccacgugaaugccaaguauuuggaaaguaccuaagugcucagcccaugggauccaaaagacacaugugca

SEQ ID NO: 2253416 - RNA, 111 nt, Homo sapiens
gccauuuuuaacauuuaauauaucuuauugagguaaaacaaggauuggauugucaaaucagacugacaagauucagagcuuucuuuuacccagucacaagaaaauaauggc

SEQ ID NO: 2253417 - RNA, 88 nt, Homo sapiens
ggagaaucacuugaauccaccaggcggagguugcagugagccgagacugcgucauugcacuccagccugggugacagagugagacucc

SEQ ID NO: 2253418 - RNA, 76 nt, Homo sapiens
ucgcuugaaccccgguugcgaacguugcagugagucgagaucagccauugcacuccagccuggggaacaagagcga

SEQ ID NO: 2253419 - RNA, 57 nt, Homo sapiens
gagcuccauuguaaucaccugguggcuugucuguuuccaccaggagacagugagcuu

SEQ ID NO: 2253420 - RNA, 62 nt, Homo sapiens
uuacuagaggcgggguuucgccauguuggcuagacugauaucgaacuccugaccucaaguga

SEQ ID NO: 2253421 - RNA, 58 nt, Homo sapiens
agaaggugaugaguuccagcauuuuuucagacuuggaucuggcuuucauuccccuucu

SEQ ID NO: 2253422 - RNA, 93 nt, Homo sapiens
uucuggauuuuaaugacucagaacuaaggguguuucugcaaaguaauggaauauagcaggacuauucuagucugaguauaaauagaauaagaa

SEQ ID NO: 2253423 - RNA, 121 nt, Homo sapiens
agccacugugaaaaugauugcuaaugguaucuggaucugguugaggagagaauguuacauaucacauccaggcuuuccugagaucagaauucaaauccaguuguccauuugggagguggcu

SEQ ID NO: 2253424 - RNA, 55 nt, Homo sapiens
agagcgcaucgcacgcuccagguggugauguccacacuggauuguacuguguucu

SEQ ID NO: 2253425 - RNA, 104 nt, Homo sapiens
ccacaaaacacauugaucaggugagccaccuccagugccaccgagagcccuacgguuuacaggcagguguucccugguugagagagacacauguguuuuagugg

SEQ ID NO: 2253426 - RNA, 71 nt, Homo sapiens
ggcgugugcaacaugccuggcuaauuuuuguauuuuucauagagaugagguuucaccauguuagccacgcu

SEQ ID NO: 2253427 - RNA, 59 nt, Homo sapiens
agcugguuuauuucuauauccuugccaaaacuggcagugcauauaggcugaaccaugcu

SEQ ID NO: 2253428 - RNA, 70 nt, Homo sapiens
agggauggaaguuauuaucuuuguugaugcucagauuauucaaucaucaaccggugagagcuuccuccuu

SEQ ID NO: 2253429 - RNA, 62 nt, Homo sapiens
auaugcacuauggaaguagcucauguaaauaaaaacugaauaaucauguccauaguguauau

SEQ ID NO: 2253430 - RNA, 72 nt, Homo sapiens
cuaccugugaagauguuucuuaauugacuuaaccaaaaucuuauugauuaauuuguauacaucuuuggguag

SEQ ID NO: 2253431 - RNA, 55 nt, Homo sapiens
acagggaguauuuauaccuagggaaaaauguuucuuuggcucuaauauaccuugu

SEQ ID NO: 2253432 - RNA, 75 nt, Homo sapiens
aguuugaagcuaaggugcuugguuacacaggccccaaaauacuauuaggccaaccaguccaaccuugcuuaaacu

SEQ ID NO: 2253433 - RNA, 87 nt, Homo sapiens
cagcaggaaucagaaaauggagaggagagaaagagaucaaggucuguuuugucaguuucccuccucuuccuccccugagucagguug

SEQ ID NO: 2253434 - RNA, 82 nt, Homo sapiens
gcuggagugcaauggcaugaucucggcucaccgcccccuccaccuucuggguuaaagcgacucucaugccucagccuccggc

SEQ ID NO: 2253435 - RNA, 65 nt, Homo sapiens
gagagaugguagucacauaugagcugugaagcugguuuacaguguagugacugccaacuucuuuc

SEQ ID NO: 2253436 - RNA, 73 nt, Homo sapiens
cuucucucuccuuugauaguguccucuuuggcagaaagucauuuuguaaaacccacaauuaaggagugggaag

SEQ ID NO: 2253437 - RNA, 77 nt, Homo sapiens
gugagauuguccugucauagauguugugccucuucccauagaaugccauagucauagauggcagggucuguccucau

SEQ ID NO: 2253438 - RNA, 82 nt, Homo sapiens
aguuaugacaaggaacuuguaugaagugauggccccaaacuccuccaaacuagcuaucaagccaaagaaaguccuuguaacu

SEQ ID NO: 2253439 - RNA, 79 nt, Homo sapiens
caagaugcccaguguguuguggauauuuaugucaacuacgacugugauuuaaaugcugcuaacauuuuugagcgccuug

SEQ ID NO: 2253440 - RNA, 59 nt, Homo sapiens
gugagaauugacacccuugucuguuacugaucuuagaagggguauauucaauuuuucau

SEQ ID NO: 2253441 - RNA, 76 nt, Homo sapiens
cucccccaacggcagguucaucccgcggcauccagacgagcuggagcuggauguggaugacccuguguugguggag

SEQ ID NO: 2253442 - RNA, 76 nt, Homo sapiens
uugagguaauaaacagccauuccuguuggauaaccccagagagugagacuuggcugcauaucccuaccugccucaa

SEQ ID NO: 2253443 - RNA, 82 nt, Homo sapiens
ucacuaguagcaccucucaugagcuucuugugaccaagaacugaguaaauucacgugaagcucuuggaaagguggcugguga

SEQ ID NO: 2253444 - RNA, 68 nt, Homo sapiens
caagcaaauaguaagggcucuguaaaugggugcaaauuugcauugccgugauuacugucuuguucuug

SEQ ID NO: 2253445 - RNA, 59 nt, Homo sapiens
auuggcuugucucccauucuggagcgucacccggccucacggagaccugcaagaccaau

SEQ ID NO: 2253446 - RNA, 82 nt, Homo sapiens
uuagguuggaccauaggaaauuccuguuuuguaguuuuuuaaacauuguuaaauagcagcaauuuuguaugguuuaaccuaa

SEQ ID NO: 2253447 - RNA, 65 nt, Homo sapiens
gcacauccagugauauagagguaugagaggccugauuuucauguauuaucauuagugggugaugc

SEQ ID NO: 2253448 - RNA, 90 nt, Homo sapiens
gagaggaucacaugagccugggagguugaggcugcaauggguugugaucgcaccauugcacuccagccuaggcaacagagugagacuguc

SEQ ID NO: 2253449 - RNA, 58 nt, Homo sapiens
ugagacggagucacgcccugucacccaggcuggagugcaguggcgcgaucuccgcuca

SEQ ID NO: 2253450 - RNA, 69 nt, Homo sapiens
cuguugagaaaucugcuguuaaccugauagguuuuccuuuauagguuaccuggugauuuugucucacag

SEQ ID NO: 2253451 - RNA, 67 nt, Homo sapiens
uuuucugacuaguuuuaaugcagauuuacuaaaagucaaaucuggcacugugaaauuuguuagaaag

SEQ ID NO: 2253452 - RNA, 69 nt, Homo sapiens
uauuagauuggugcaaaaguaauuguggguuuugccauugaaaauaauuacuucuacaccaaccuaaua

SEQ ID NO: 2253453 - RNA, 76 nt, Homo sapiens
ucgcuugaaccugggaggcggagguugcagugagccgagaucgcgccauugcacuccagccuggcagcaagagcga

SEQ ID NO: 2253454 - RNA, 55 nt, Homo sapiens
gaaauuauuuucagaauggagaaggcaguugucuucaucagggagaaauaauuuc

SEQ ID NO: 2253455 - RNA, 55 nt, Homo sapiens
accaccgacagcugcauuuuucucagagcuggaagcaugcacagcuguuuguggu

SEQ ID NO: 2253456 - RNA, 116 nt, Homo sapiens
uugccuccagauggcuuuaggggccaugcagagggcagugguagguaugagggagccagcggaggcuucuuuggaggcgaucuguuugaugugauacggucuguggauggaggcag

SEQ ID NO: 2253457 - RNA, 76 nt, Homo sapiens
uuaaaaaaauguauagaugcugcagucaggcauuacauaaaucaucugcugaaaugugcacauaacauuuuuuuag

SEQ ID NO: 2253458 - RNA, 100 nt, Homo sapiens
ugaccauguggagaagagcugcccuguugcccugaauacauauccaggccugacaaacucauauguuguucggcuguaacaugccugucucugcugguca

SEQ ID NO: 2253459 - RNA, 69 nt, Homo sapiens
ggagcuugcuacuaugccuggcuaauuuuuuaaguuuuuaguauguugccuaggcuggucuugaacucc

SEQ ID NO: 2253460 - RNA, 67 nt, Homo sapiens
cauucggaaagggugcaggguagaaggggccacauguagauacuuugccuuuguacuuuuucuaaug

SEQ ID NO: 2253461 - RNA, 61 nt, Homo sapiens
guauuagguuggugcaacaguaauggcaaaaaccacaguuacuuuugcaccaaccuaauau

SEQ ID NO: 2253462 - RNA, 58 nt, Homo sapiens
uuuccauggaaaaccauucaaugaaauguuuaauucauugaaugguuuuccuugggag

SEQ ID NO: 2253463 - RNA, 70 nt, Homo sapiens
agcuguuguuuuaagauacuaaguuugugguaauuuguuacacagcaauagaaaauuaauacagcaugcu

SEQ ID NO: 2253464 - RNA, 83 nt, Homo sapiens
uugcuauuaaaucauguccuaggugggguggauaauguuccccaugcauuaacacccuucuccagguacauuuuaagcagcag

SEQ ID NO: 2253465 - RNA, 92 nt, Homo sapiens
accauggacuauaacagcugcaaggcaaaagcagcaaauaaucaauggagaaaugccuggcuuuugccuuuggucuuuaucuaggucugggu

SEQ ID NO: 2253466 - RNA, 57 nt, Homo sapiens
ugcugguuuucaucaucaguggccuugucauccuggccuacugcucccaggccagca

SEQ ID NO: 2253467 - RNA, 87 nt, Homo sapiens
ggagaauagcuugaacucgggaggcggagguugcagugagcugagaucacgccauugcacuccagccuugugacagagugagacucc

SEQ ID NO: 2253468 - RNA, 62 nt, Homo sapiens
caauguguccauguguucucauuauuuaacucucauguauaagugagaacaugugguauuug

SEQ ID NO: 2253469 - RNA, 89 nt, Homo sapiens
cccccagucccgggucaugucuugaaauucaguuuucugcugaaagaagcugagacuacuuggacaaaugguugauaccggguuggggg

SEQ ID NO: 2253470 - RNA, 58 nt, Homo sapiens
gcagucaacuuuugcuuugagcccugauaaauacaucaccccuaaggcaagagucugc

SEQ ID NO: 2253471 - RNA, 72 nt, Homo sapiens
agggugcugguguagagugcagaaagguaggccuuaucaccuuuucuuaucuucucucucaucagucauccu

SEQ ID NO: 2253472 - RNA, 88 nt, Homo sapiens
agggggauggagugggaaggugguuuucucuuggagucggguguucaguggccugacucuucucugaccgccccagccauauuccccu

SEQ ID NO: 2253473 - RNA, 56 nt, Homo sapiens
cugucuggaguccuucgugugcuuguugauucacucugcaugaccacccuaggcag

SEQ ID NO: 2253474 - RNA, 64 nt, Homo sapiens
gauaaagauagcaauagggacaaaaaguaaaauaaucucuuguguuauuauugcuauuauuauu

SEQ ID NO: 2253475 - RNA, 85 nt, Homo sapiens
cuugaguccaaguguuugaggcuguggugcacuaugauugcaccugugaauagucauugcauuccagcccaagcaacagagcaag

SEQ ID NO: 2253476 - RNA, 76 nt, Homo sapiens
auuaauaaagaagugucucuaauuaguggggagaugauguacgcuucaguaaauguuaggacauuucaugauuggu

SEQ ID NO: 2253477 - RNA, 60 nt, Homo sapiens
ggucuagauagcauuucucuucagcugauacccuagucugagauccaugcuauuugggcu

SEQ ID NO: 2253478 - RNA, 59 nt, Homo sapiens
uguuuuguuagcacucugggaacuguuagucuuucacuacccagaagcuuaacagagca

SEQ ID NO: 2253479 - RNA, 55 nt, Homo sapiens
agcacagcagugagccaaggagacgggacccucugcuuuguccuccugcugugcu

SEQ ID NO: 2253480 - RNA, 79 nt, Homo sapiens
gcucugauggagauauacaaggagauuaauguuguauucaugccagcuaacacaacauccauuuuguaguccauggagc

SEQ ID NO: 2253481 - RNA, 63 nt, Homo sapiens
gcacaccuaguuaauuucugcauaaugaaaauuucauauugcgguucauugacuuuugugugu

SEQ ID NO: 2253482 - RNA, 77 nt, Homo sapiens
uaguagaagccuucaguggacauuuucaucuuacauacuugaaauggagaugugcgaacugaguaauauuucuacua

SEQ ID NO: 2253483 - RNA, 70 nt, Homo sapiens
guugcuguguagagaaaaguaccauuuucagaauuuuuugaaaauugugaguccuuuacaaguuggcaac

SEQ ID NO: 2253484 - RNA, 104 nt, Homo sapiens
acagccaguaagugauguagcuggguacaaacuuccaucuccuugacaucaggcuggagaucuuugaaguguugugccugggacuauuuccccucucuguuugu

SEQ ID NO: 2253485 - RNA, 75 nt, Homo sapiens
ugcaagccuguggccccuagcuacuagagagacugaggugggaggaucacuugagccugggaggccaaggcugca

SEQ ID NO: 2253486 - RNA, 58 nt, Homo sapiens
cauuuaauagaugcuguuucaggcuacugaggaaagacagaacagugucuaugaaaug

SEQ ID NO: 2253487 - RNA, 74 nt, Homo sapiens
guugagugcaauucaggggagguggcuaugagaauuucaaucauggaaaucuaaguuuggauugagaucucagc

SEQ ID NO: 2253488 - RNA, 64 nt, Homo sapiens
uucaguuugccaguauuuuauugaggauuuucacaucgauauucaucagggauacuggccugaa

SEQ ID NO: 2253489 - RNA, 55 nt, Homo sapiens
ugagcuuuuauuaugugcaaggcauugcucuaagcacauuacaaguauuagcuca

SEQ ID NO: 2253490 - RNA, 84 nt, Homo sapiens
cccugaaguaggaucaugagucccugagaccugugacugugcccugugccucaugugccacaguguuaagggauucuuuuuggg

SEQ ID NO: 2253491 - RNA, 90 nt, Homo sapiens
aggcauuguacuuugcacuggagauucaaugggaagcaacaauggauaaggcuguugcccuaugaauuuaugguguaauggauaaggcuu

SEQ ID NO: 2253492 - RNA, 74 nt, Homo sapiens
uuaaaucaguaggcuacuccuuaaaaugacuuccuaaaauaucuuugucaaacauuuggaagccuuugguuuaa

SEQ ID NO: 2253493 - RNA, 57 nt, Homo sapiens
cagcuugugguauugcugguuguauuuauucaguguuaucugcaaacacacaggcug

SEQ ID NO: 2253494 - RNA, 88 nt, Homo sapiens
gggucuugcucuguugccuaggcuggagugcaguggcgcaaucucagcucacugcaaccuccaccuccuggguucaagcgauucuccc

SEQ ID NO: 2253495 - RNA, 76 nt, Homo sapiens
accaccaggaacguuuugaugccaugacucaaauacguauuuuggugcugcaugacucagaucuguuccugguggu

SEQ ID NO: 2253496 - RNA, 102 nt, Homo sapiens
ucucucucucucccacuguaaaacugauugaggugcuuaagguucucaagaaauugcuacucauagcccugugauuacuuuuauaaaggcgggggggagggg

SEQ ID NO: 2253497 - RNA, 61 nt, Homo sapiens
gcaugagaucaaauuuaagcuguuauuagcauaaaauagccuguuuuaagaugucuuaugc

SEQ ID NO: 2253498 - RNA, 94 nt, Homo sapiens
gguccuuccucagguccgaaucagaaacuuuggagaauggcacuacuguuuaacgagaccuucaaguaauucugauggcuagaguuugaggacc

SEQ ID NO: 2253499 - RNA, 88 nt, Homo sapiens
ggguugguuccaagucuuugcuauugugaauagugccgcaauaaacauacgugugcagaugucuuuauaguagcaugauucacaaccc

SEQ ID NO: 2253500 - RNA, 57 nt, Homo sapiens
agggauccuuuugucuagucuuccucacaguaggaaaucuuagcugaggggaucucu

SEQ ID NO: 2253501 - RNA, 85 nt, Homo sapiens
cagccucacugucugagguguuauccagaguucuuugugucaugaccaagaaaaacaaggagcauauacaccaacagugagguug

SEQ ID NO: 2253502 - RNA, 55 nt, Homo sapiens
cacccuuagaguuggaaguggggucagcucuauuccucaaaagaaaacuggggug

SEQ ID NO: 2253503 - RNA, 78 nt, Homo sapiens
ugccuugguagugauuaauaguacagguucuuagauuuagaccauuuaggcucuuuaucaguuaacucuugccaggua

SEQ ID NO: 2253504 - RNA, 87 nt, Homo sapiens
gaaggcuuaagaagugagauauucugguuuacuaaaucucuuuauggauucaguauuaaccagaaauuucuuuuuguugagacuuuu

SEQ ID NO: 2253505 - RNA, 77 nt, Homo sapiens
uaagggagauuuccuuugggcacuggagaugguggcuguugggccauaaucauccagccccagaagggaggaccuua

SEQ ID NO: 2253506 - RNA, 60 nt, Homo sapiens
ccaaaaucugaaacuuucuguauauaaacaugauguucuagugugcauuucagauuuugg

SEQ ID NO: 2253507 - RNA, 60 nt, Homo sapiens
ggccugggagaagcacccagccucacgccugcggcaugcgcugccuggguuucccuggcc

SEQ ID NO: 2253508 - RNA, 74 nt, Homo sapiens
aacuaccuggucauggugauuugcgccuucuauuugggaggaugaggugggagaaucacuugagcccaggaguu

SEQ ID NO: 2253509 - RNA, 71 nt, Homo sapiens
guuccagcuuauagguagauuuaaaauuugucugguuggcaauugguugaguuuaucuaaagaccugggau

SEQ ID NO: 2253510 - RNA, 59 nt, Homo sapiens
aagucuuuagugacauguuugggagacuggagauuccuaaagucugucacugaggacuu

SEQ ID NO: 2253511 - RNA, 81 nt, Homo sapiens
uuaauggaucuaggcauuaaguggcauugccugccaacaucagcaaagaguggagugcaguugucacgugccuucuguuga

SEQ ID NO: 2253512 - RNA, 68 nt, Homo sapiens
ggccacggggcugacauguuucucucuguuuacuggucacacgaccagauaaacguguccccgugguc

SEQ ID NO: 2253513 - RNA, 89 nt, Homo sapiens
gcccaaaggcccccaaggggcggggaaauggagaccagguggcuugcacuuuggacucccuccccagcuucaggugggcugccuugggc

SEQ ID NO: 2253514 - RNA, 89 nt, Homo sapiens
uaguuuauaccaaauacauuaauuaggaaaauguuauaaaaacuuguuagauguuguuuagccuuugauguuagaaagguauaaaucua

SEQ ID NO: 2253515 - RNA, 74 nt, Homo sapiens
gggcauaaugcuaagagcugccccucuuucucaucuggaaaggaagggcaguuccuuaacauuaauuauuguuc

SEQ ID NO: 2253516 - RNA, 128 nt, Homo sapiens
auuugagaugauucuauggcaacagaaaugugcuugagggaaaucaguugcggcaucuucuauaauugugucaccuagauuuugccuuaggaauuucuagauuuccauagaacauugugaccucaaau

SEQ ID NO: 2253517 - RNA, 83 nt, Homo sapiens
cccaacccuagaucuggcuggccuuauuuguucaaggcacuagauacuugugaacaugacagugggcuaguuuggggccuggg

SEQ ID NO: 2253518 - RNA, 79 nt, Homo sapiens
ggagaaggauguccauuucaaaccucauuugcagcugcuuuuuagucuuagugguuuuggaauggaauucaucugcuuc

SEQ ID NO: 2253519 - RNA, 55 nt, Homo sapiens
auggaguguggaacugggaaucugacaaguauggauuccaauuuuggcacaccau

SEQ ID NO: 2253520 - RNA, 127 nt, Homo sapiens
ggaagggaugaaggugauagggucuccuuggcaaagagacaugcaucggggcuuugacaaacaugaguccuccuuguuuugucucugcugauuaaugaggagaugcugccaucuuucuuuacuuucu

SEQ ID NO: 2253521 - RNA, 79 nt, Homo sapiens
ugccuggaguacaguucucuuuguugucaguuaaauagagaaccacaugccauaacauauaagagaacuguaaaaggua

SEQ ID NO: 2253522 - RNA, 130 nt, Homo sapiens
auuaauaauugcuagaggcucccugagcacauuaacaauuuccauguccaaaaauuaguuuuaaccuguaacaguacuuuuggauuugugaaagauugugugugguagaagcauugagguuuguuauuuu

SEQ ID NO: 2253523 - RNA, 83 nt, Homo sapiens
agucuucaucugucuagcucaccaacuucaauugauggguaacagaaggucacaccugguuggucagcucaauggagaggguu

SEQ ID NO: 2253524 - RNA, 59 nt, Homo sapiens
uuuuaguuacugcaguagcaaagagauucaugaguuuagccuauugcacauagcugaag

SEQ ID NO: 2253525 - RNA, 79 nt, Homo sapiens
uccugagguaaaacucaugaaaguguguggaaacuugaaguuuuuaacucucaaucuauuccacuuucauccucuagga

SEQ ID NO: 2253526 - RNA, 79 nt, Homo sapiens
gucagccaugagggagggcaccugaccuugggaguucugucucgcccuaggguggagugcuuuuccucgguugguugau

SEQ ID NO: 2253527 - RNA, 72 nt, Homo sapiens
aaugauuggauagucuuuaucuguuggauaacuucauuuauaaaucuagagccauggggcuauucauucauu

SEQ ID NO: 2253528 - RNA, 100 nt, Homo sapiens
gagacaggagacucgcuuguacccggcaggcggagguugcagugagccaagauugcgccauugcacuccagccucggcaacaagagcgaaacuccgucuc

SEQ ID NO: 2253529 - RNA, 81 nt, Homo sapiens
uuguacucuucacagucuggguuuguuuguacuugccuuucuuguggacagguacaaacaagcccagacugugaaggacaa

SEQ ID NO: 2253530 - RNA, 73 nt, Homo sapiens
gacaugaaauuugggagggaccaggaacagaaugauaugguuuggauuuguguccccacccacaucucauguu

SEQ ID NO: 2253531 - RNA, 70 nt, Homo sapiens
agcacauauugaauauuuaauaggcaucaucaacuuuugucuaugaucacuguggaaauucagcugugcu

SEQ ID NO: 2253532 - RNA, 116 nt, Homo sapiens
aggauuuauauuuugaauacagguugaguaucccucaucuggaaugcuugggaccagaaguguuuccaguguuuggauuagggaugcucagccuguaguuuuaugugucaaguccu

SEQ ID NO: 2253533 - RNA, 60 nt, Homo sapiens
uccuugagucugaacuuuggauuuugaauuaaugccaaaacaaguucagauugucaggga

SEQ ID NO: 2253534 - RNA, 57 nt, Homo sapiens
uuugcagagucuuucgcugggcugucuccccaucagcaagagaaagagcucuccaaa

SEQ ID NO: 2253535 - RNA, 82 nt, Homo sapiens
ugguuugaagucacuguugaccuuagcaagagagccagcuggagaugcuuuugcugggucagcggugguaacggugaggcca

SEQ ID NO: 2253536 - RNA, 89 nt, Homo sapiens
cugaaacagcacucaagugugauagaauaucuuuccuuuaaaacugugcucugaaaugaagauguugcuuaccuuggagucucaaucag

SEQ ID NO: 2253537 - RNA, 102 nt, Homo sapiens
uaaagugauuauuaucagacauacuguauugggaugugaagcuuucuguuuauaauuggagcccuaaacuucuaauauaguaugucugcuaauaauacuuua

SEQ ID NO: 2253538 - RNA, 70 nt, Homo sapiens
ccugagggucuucuaauuguagauuccaauuccauagguuuuggcuacagauuaugaauuucuaaccagg

SEQ ID NO: 2253539 - RNA, 55 nt, Homo sapiens
uauggagggcugacuguacuuuuaagaugcaaguuugaaguguuuguucuccaug

SEQ ID NO: 2253540 - RNA, 104 nt, Homo sapiens
gauuguauuuugcaaugugagaagaacgugauauuuagggggccgggauggaauaauaugguuuggaugucuguuuccuccaaaugucaugucaaaauguaauc

SEQ ID NO: 2253541 - RNA, 83 nt, Homo sapiens
gguuucaccauuuuggccaggcuggucucgaacuccucaccucaggugaucuguccaccucagcuucccaaagugcugaaauu

SEQ ID NO: 2253542 - RNA, 58 nt, Homo sapiens
ucuucauucucgccuuugucgucagcauuuauggagcuaggcacugugugagugagga

SEQ ID NO: 2253543 - RNA, 71 nt, Homo sapiens
cugauuugugaucuucagaaaguggcuuaaucacacugaaucuuagcuuacuugcuuggagaauggauuag

SEQ ID NO: 2253544 - RNA, 64 nt, Homo sapiens
uucaguuugccaguacuuuguuguggauuuucucaucgauguucaucagggauauuggccugaa

SEQ ID NO: 2253545 - RNA, 112 nt, Homo sapiens
gggauugcuggguuggaugguaauucuguuuuuaguucuuugaggaauugccacauugcuuuccacaauggcugaacuaguuuacucucaccagcaguguauaagugauccc

SEQ ID NO: 2253546 - RNA, 62 nt, Homo sapiens
ggggcauugugacauaucucugggccuacacccagguuauaugacugucaugccugugcccc

SEQ ID NO: 2253547 - RNA, 69 nt, Homo sapiens
uugggguagaauugcaacauauaaauuuugggggaacacaaguauucagaucauagcauucugccccag

SEQ ID NO: 2253548 - RNA, 130 nt, Homo sapiens
ccagagacaaaagggauacgaauguuagggcuuuaguuugcuuguguuugaacaccuacacaugcacaaaccuggccaaacuacagcuuucuccaaauuuuauuucuuuuuuuuuuuuuuuuuucuuugg

SEQ ID NO: 2253549 - RNA, 80 nt, Homo sapiens
gacuccuguaucacagaaagguuugguuaaauaaauuuguuacguuuuucucuugcuaaucugucuuuguuauagggguc

SEQ ID NO: 2253550 - RNA, 73 nt, Homo sapiens
ggcaccacugcacuccagccugggugacagagugaucgcacuacugcacuccagccugggugagagugagacc

SEQ ID NO: 2253551 - RNA, 85 nt, Homo sapiens
ggguagcaaauagacggaacaccauuuuuccugccuuuaaaaaguauauaagggccaggcguggugguucacgccuguaauaccc

SEQ ID NO: 2253552 - RNA, 55 nt, Homo sapiens
ucaagaggaacuugacuucagaaaccuuuuagguagauucaucuguuccuuuuga

SEQ ID NO: 2253553 - RNA, 57 nt, Homo sapiens
ggugauuaauacccuguuaacaggaugacagaauugucuugugcaauauuaaccacc

SEQ ID NO: 2253554 - RNA, 67 nt, Homo sapiens
gagucacacugccuagaucugaaccuggcugucaauucccagcugugugcuuuuaggcaggugacuu

SEQ ID NO: 2253555 - RNA, 58 nt, Homo sapiens
uuugcuauugugaacagugccgcaauaaacauaugugugcaugagucuuuauaguaga

SEQ ID NO: 2253556 - RNA, 55 nt, Homo sapiens
aagcuggagugcaguggugcaaucuuggcucacugcaaccucugccuccuggcuu

SEQ ID NO: 2253557 - RNA, 77 nt, Homo sapiens
aggcacuacaggaucugccggcccauaccuaaaguucuggugcaggugucuucccuugguugauccuccuagugccu

SEQ ID NO: 2253558 - RNA, 77 nt, Homo sapiens
guacugcagacauguggauggagguguggggagugaguuagacagcuuugggcccugaccuccauucugagcagugc

SEQ ID NO: 2253559 - RNA, 90 nt, Homo sapiens
ggcacaacggaccacauauugcaugauuccauuuguguggaauggcuggaacaggcaaauccauagaugggaaacagauuagugguugcc

SEQ ID NO: 2253560 - RNA, 73 nt, Homo sapiens
cgccugagagaugagaccucucacugagguguguuguccucucacugaggugugugguccucucacuuaggug

SEQ ID NO: 2253561 - RNA, 112 nt, Homo sapiens
agugcugaugaugcaacaaguaauuaacuuucugugacgcaaagcugggaaggcagcuguggcuauuuuccaguuguucuagaaagcuagcgccuaggccuuugucagcgcu

SEQ ID NO: 2253562 - RNA, 81 nt, Homo sapiens
gcaaggguugaggacugguugaaagcuuugccacauucuauacauuugaaagguuuuuuuccaguaucucuuaucuuaugu

SEQ ID NO: 2253563 - RNA, 55 nt, Homo sapiens
uuccuccagacaucccauguuucauugacaccaauaaugauugucuauggaggaa

SEQ ID NO: 2253564 - RNA, 64 nt, Homo sapiens
uugcccuauauccagauucugucuacuaaauccacccccacuggccuguuuggguacuggguaa

SEQ ID NO: 2253565 - RNA, 97 nt, Homo sapiens
gcuuuuuauguuccuauagcauuuguacaaaaugcaguaggaguggaaucauuauucuaaauugcauaaguacaaaugaaauggaagagcacaaagc

SEQ ID NO: 2253566 - RNA, 57 nt, Homo sapiens
uacauggguggugggaucuguaccucaaaccgcagcauugcacaauauacccaugua

SEQ ID NO: 2253567 - RNA, 56 nt, Homo sapiens
guuucgucuugcccagccuuuucagugauguucauaaaaggcugugagaacgagau

SEQ ID NO: 2253568 - RNA, 94 nt, Homo sapiens
ugcucucugguucgagcaguauucccauagcuagagaggagaauacaguucuggcacugaugugggaugcuuguaaaaugcaguuagaagagcg

SEQ ID NO: 2253569 - RNA, 100 nt, Homo sapiens
ugagacagaagaauugcuugaacccggaggcagagguugcagugagccaagauugugccauugcacuccagccugggugacagagcaugacuccgucuca

SEQ ID NO: 2253570 - RNA, 59 nt, Homo sapiens
guagagagaaauacaaagcuguauucauagcaggacauggcaggagguauuuucucuac

SEQ ID NO: 2253571 - RNA, 59 nt, Homo sapiens
cagacagugucccgagucccugggugcaguccuuccagaggccaccgugacucugucug

SEQ ID NO: 2253572 - RNA, 73 nt, Homo sapiens
aauaacuugaagaucucuuccaaaccugaaauuguguguaucacagacauugauggaaggcaucugcauuauu

SEQ ID NO: 2253573 - RNA, 77 nt, Homo sapiens
uggauuccauggucaccacaacugugcgcucagccugcagcaggaggggguauguaagugagugagugcagggucca

SEQ ID NO: 2253574 - RNA, 65 nt, Homo sapiens
uuuuugguugguaggcuauuaauuauugccucaauuuuagagccuguuaguggucuauucaggga

SEQ ID NO: 2253575 - RNA, 67 nt, Homo sapiens
gaugaugaucugagagcuuguuacauaaugcuuucaauccugugaggcaaguacuaucaucauuauc

SEQ ID NO: 2253576 - RNA, 59 nt, Homo sapiens
uuuuugaggggauccaaguguucuaaaauugauuguagugacauagagacucucaaaaa

SEQ ID NO: 2253577 - RNA, 78 nt, Homo sapiens
gggaggaaguuggucaaugugauuaggccaucugugugugcuaauugaugcuuaucuaaguuaggcuccuacccuccc

SEQ ID NO: 2253578 - RNA, 84 nt, Homo sapiens
gugcagguuuauuacuuagguauaugugugccauggugguuugcugcaccuaugaacucaucaucuagguuuuaagccccgcau

SEQ ID NO: 2253579 - RNA, 59 nt, Homo sapiens
ugagacggaguuucgcucuugucacccaggcuggagugcaauggugcgaucuccgcuca

SEQ ID NO: 2253580 - RNA, 71 nt, Homo sapiens
gucaaauguuauaauucaacaaucaagaugggauucgaaucugugucuaguuuugaaguauagcaguugac

SEQ ID NO: 2253581 - RNA, 99 nt, Homo sapiens
gggauggaggggaacugguugcaguguuaaacaagguaggggucaauaugggcuuuaccugagaaggugacauuugagcaccuuaguuguccuaauuuu

SEQ ID NO: 2253582 - RNA, 129 nt, Homo sapiens
uuacauucucuaaauacauauugucuaccugggacuagguuauacucugaaauggugcuauuaauaaaugaaucaaaguuuuaccuuuuaagagauaguagucaagauaggcacagauauacaauguaa

SEQ ID NO: 2253583 - RNA, 110 nt, Homo sapiens
cugggaagaccuuuccgucggucugucagucugucccugccuggcgggcuuucucugggaaccgcugcagacgcgcuggcgaaagcaccaccgccaagagucaugcucag

SEQ ID NO: 2253584 - RNA, 103 nt, Homo sapiens
uugagacagagucuugcucuugucgccgaggcuggagugcaguggcgccaucucggcucaaugcaaccuccaccucuggguuccagcaauucuccugccucag

SEQ ID NO: 2253585 - RNA, 71 nt, Homo sapiens
gaagucagguacaauaaccuuagaauaacaucagaguuacuugaguucuuuuagggauauugcuugauuuu

SEQ ID NO: 2253586 - RNA, 76 nt, Homo sapiens
aguuuaguggguuuguuuuauucaauagauuacaaacaaaauguuucuuugcguugaacaaagccauaauuaaauu

SEQ ID NO: 2253587 - RNA, 90 nt, Homo sapiens
uauuggauuagaagcauuaggaugaaagaaucuuguuuucauaaauugguggagaacugacauuaucguguauguuacuauuguucaaua

SEQ ID NO: 2253588 - RNA, 59 nt, Homo sapiens
ccuugccauuugguacaguugguauaaauuaaccuagccacugggcuaccgaaguaagg

SEQ ID NO: 2253589 - RNA, 92 nt, Homo sapiens
gcacagagagagaaaagucagaauccuggcuaguaagaaauucuugcucuuuuucuggcaugucagguuucuggguuaucuuucucugcagc

SEQ ID NO: 2253590 - RNA, 64 nt, Homo sapiens
cugcuguaguaagucauuauguuuguagaucuugcaaugcagaaauagaagacuagugcagcag

SEQ ID NO: 2253591 - RNA, 74 nt, Homo sapiens
ucacauaggcaagaugagguuuuuauucagcucuaaaaaucaaaugauaaaaguuuccaaucaugccuguguga

SEQ ID NO: 2253592 - RNA, 72 nt, Homo sapiens
ugagugaaagaagcacuaaggaauguugaaguaaggcaaaauguugauggcuauagugcuugcuguuccuca

SEQ ID NO: 2253593 - RNA, 71 nt, Homo sapiens
ggggaauccuauacuguuggagggcauguaaauuaguacauccacaauggagaagaguaugaagguuccuc

SEQ ID NO: 2253594 - RNA, 119 nt, Homo sapiens
ccugcaaggggcacuagcaaggagccagugacauaaggcagaagcuucguggcugucaaaaagaagugcgaucuuuuuccuuguuccugggaauccugcaaacaugucugccccauagg

SEQ ID NO: 2253595 - RNA, 118 nt, Homo sapiens
ugggggaccugcaggggcaaaggcaucugcucggcucccucagugaggacaaacaugaaguggagagagaggugccugcgcucacugucccuccuaacagcaaacccaaggucuccca

SEQ ID NO: 2253596 - RNA, 130 nt, Homo sapiens
acugcaaccuuccccuccugguucaagcacgucuucugucucagccucuccaguagcugugacuacucagaggcuacucagaaggcugaggcaggagaauugcuugaaucugggagguggagguugcagu

SEQ ID NO: 2253597 - RNA, 56 nt, Homo sapiens
uacagcacaggugcagguguugcuuguccuggggccaaggcgccucccugucugug

SEQ ID NO: 2253598 - RNA, 57 nt, Homo sapiens
ugugagucuaacuuuuggaugaggaaaagaguaguuccuguccuagaggaguucaca

SEQ ID NO: 2253599 - RNA, 60 nt, Homo sapiens
gguuaaaagugucacagucaugaaagucaaagaaaggcuuucauggaggcauuuuagauu

SEQ ID NO: 2253600 - RNA, 63 nt, Homo sapiens
ggguugcaugggagcugggugaggccugugacuguaggcuuucccccacuucccugacaaccu

SEQ ID NO: 2253601 - RNA, 107 nt, Homo sapiens
uuuuugauuguccauacuuaggcugccgcuaugcauguauaguggguagaagccagggaugcuucuaaacaucuuacaaugcauaggguagucuccugcaacaaaga

SEQ ID NO: 2253602 - RNA, 64 nt, Homo sapiens
ugucacugugcagucaugcauucugugaugagguuucggucaaugccggacuguacauauggca

SEQ ID NO: 2253603 - RNA, 60 nt, Homo sapiens
ucuucuggagcaugauggccuaaagcagaggagacaaauuagguuauuauaauuagaaga

SEQ ID NO: 2253604 - RNA, 58 nt, Homo sapiens
cuuugcauucacuguaugcaugacauacuacugucuuauagugcaaugaauagcagag

SEQ ID NO: 2253605 - RNA, 63 nt, Homo sapiens
acacacugaaguauuuuagugugaaacauuaggugucagaaauguuaagguacuuagaugugu

SEQ ID NO: 2253606 - RNA, 79 nt, Homo sapiens
ucucugucccuuuugucugaagaccccauuuagcuuucuccagucagcuccaugaguccauuagaaaaaaggacugaga

SEQ ID NO: 2253607 - RNA, 103 nt, Homo sapiens
agguuuguuacauggguauauugcaugaugcugagguuugggcuucuaaugauucuauugcccaaguggcaaauguaguacccaauagguaguuuuucaaccu

SEQ ID NO: 2253608 - RNA, 61 nt, Homo sapiens
acuuauucguuuuggcugaggaccacagcaacacuguggaauguuuaucaaaacaguaagu

SEQ ID NO: 2253609 - RNA, 66 nt, Homo sapiens
uuacagucuuaggcagugcuuuauagcgauaugacaauagacuaguacagcacugcuuuacuguag

SEQ ID NO: 2253610 - RNA, 88 nt, Homo sapiens
gcucaaaauaauccuuauccaaaguggcauauuauaggguagcauauucugaucuucuauaacagugugguuuggagauugauugagu

SEQ ID NO: 2253611 - RNA, 64 nt, Homo sapiens
cuuccuucacuuuuuaugccagauugagacaguuucuucuauuuggguaaugagugcaagggag

SEQ ID NO: 2253612 - RNA, 66 nt, Homo sapiens
uguuucuaguucuagauccuugaggaauccccacacuggcuuccacaaugguugaacuaguuuaca

SEQ ID NO: 2253613 - RNA, 57 nt, Homo sapiens
uuucaugggaaaagcagagugcaaaauucucagccuaccuuugccacuucccagaaa

SEQ ID NO: 2253614 - RNA, 66 nt, Homo sapiens
cucuacagugacagaaagcugauuauuuccagggucagggugugaugagcauugucuacaaaggag

SEQ ID NO: 2253615 - RNA, 57 nt, Homo sapiens
guuggaauuaaaaggcaaguauggccaggcacaguggcucaugccuguaauuccagc

SEQ ID NO: 2253616 - RNA, 88 nt, Homo sapiens
cuuuguaaggcaguuagagcaaauuuagauaccuuuucuagguaaagaauuaucuguucugauuaaacaaacauucugcuuuauagag

SEQ ID NO: 2253617 - RNA, 81 nt, Homo sapiens
gauaauuauuauauguucucauucauaugugggagauaaaaaaaugaacucauggagauagagaauauauugaugguuauc

SEQ ID NO: 2253618 - RNA, 80 nt, Homo sapiens
aagaguuauuggaaauauaguagagagggcaaaaugcuuaaugaacauuagcaaugcugcugcugcugguauuugcucuu

SEQ ID NO: 2253619 - RNA, 112 nt, Homo sapiens
aagcguauaagcuuucaguuauaagauuaaaaaauucuaauguauacagcaugaugguuacaguuaauaauauuauaguguauacuugaaauuugcugagaguguagaucuu

SEQ ID NO: 2253620 - RNA, 124 nt, Homo sapiens
uuccauaaacuuuccuuagcuuuagguuauacacaggguuacaucucaaguggagucuugucugccuguuuacuagaccacuuuagagauuguucaaacccaaauagccaggagagagauggga

SEQ ID NO: 2253621 - RNA, 124 nt, Homo sapiens
gaguuggugaggagguacauacuggguccuccaaugagaucaugaaaaaccacugggcuuuauucuggugucaugaagguuuuaugcagggcaguaacccagacuguguccuucucccaaauuc

SEQ ID NO: 2253622 - RNA, 87 nt, Homo sapiens
gaggacuccuaagugaggcuuuuccuguuagacuacguauuaagcaaggucagaguuugccagguaaggacucaauauggaggccuc

SEQ ID NO: 2253623 - RNA, 112 nt, Homo sapiens
gcucuccuugggccuuagugucagcucuaaagauuuauaaagguugcacuggaaccucuuuccaguuguuauuuuuauaaaggaucagugacauuuugaggcagauaagagc

SEQ ID NO: 2253624 - RNA, 65 nt, Homo sapiens
ucugugcuugucauaugcuuugaauuaacagaccuauuaggaaugaguauuugacaggaaacaga

SEQ ID NO: 2253625 - RNA, 84 nt, Homo sapiens
auuuuuaugacguuuuauuggcgcaguuguuacuucuucuccucugcuguaauaaugugccauaaaguagaauuucauuuaaau

SEQ ID NO: 2253626 - RNA, 59 nt, Homo sapiens
gguucaagcaccaggauccaucaguuuugcuggaccaucugugagacugguuuugaacu

SEQ ID NO: 2253627 - RNA, 76 nt, Homo sapiens
cuuuauggccagcuguguccuaucuguaagcagcauagcuugccagcugcucuucuuagcacaucuggcuguagag

SEQ ID NO: 2253628 - RNA, 59 nt, Homo sapiens
cuucacggugccuacuugugucuaugcuugucucugcuuaaaacacaagcaccuugagg

SEQ ID NO: 2253629 - RNA, 72 nt, Homo sapiens
uauacuagucaagaauguaugaggaaacagaauucauucuucugggcauuuauaacauuucuuaccugugua

SEQ ID NO: 2253630 - RNA, 58 nt, Homo sapiens
gcuaugaucacuacagcagggaugagcguguacacaucuucaaagaaguggucauagu

SEQ ID NO: 2253631 - RNA, 58 nt, Homo sapiens
ugcugcuguuaucauuuuaccagcaaaccaccugccaugcaaugcauugacagcagca

SEQ ID NO: 2253632 - RNA, 66 nt, Homo sapiens
acuuagagugcuuuauuagauguagcuuggagauuauagggugccacuaaagaaccacucccaagu

SEQ ID NO: 2253633 - RNA, 130 nt, Homo sapiens
cagcugcuaauggguggagacccccucacucccaccccacuuccugccugcugaugcugccugagagcuuccuggcaguuucucaggcagggguauggggaaggaggggggcccuacucaccuuuagcug

SEQ ID NO: 2253634 - RNA, 72 nt, Homo sapiens
gcuucccaagaauugaaugauugucuuaugagagagugaaauuuccaucaucaggcucauucaagcugaagu

SEQ ID NO: 2253635 - RNA, 81 nt, Homo sapiens
ggucuugcucugccaccagguuggagugcaguaaugcaaucucagcucauugcacuccagccuggaugacagagcaagacc

SEQ ID NO: 2253636 - RNA, 94 nt, Homo sapiens
accccaugacauugauuagcacaucuucuuggccugcaacucauucauaugugcauauuuugucggcccaaugagaguguuagcagaaaggggu

SEQ ID NO: 2253637 - RNA, 77 nt, Homo sapiens
aacgaauuagcaaguguuuaagcacuuuuaucauaggagaggagcucaauaauguuuguuuugcuuguuaauuuguu

SEQ ID NO: 2253638 - RNA, 115 nt, Homo sapiens
gagccagugagauguuuuugcugacaguuauggccuaugacagguauguugccaucuguaacccuuugcgcuaccuuauaagucaugaacccccagcuaugccuuugguugguuc

SEQ ID NO: 2253639 - RNA, 62 nt, Homo sapiens
ucagucuacagcacugagcugugugcagggcuccuaugcacccugucagucuguagcacuga

SEQ ID NO: 2253640 - RNA, 77 nt, Homo sapiens
gauaauuauugagcacugacucugugccaggaacauguacaaaguaccuggcacagaguaagugcucaauaauuguu

SEQ ID NO: 2253641 - RNA, 119 nt, Homo sapiens
cgugaacagugauuucuguggauaugcaauucuagauugauaguauuuucucccagcacuuugaagaugugucauugguuucuggauuucaucauugcuauuaaaaaucaacugucaug

SEQ ID NO: 2253642 - RNA, 56 nt, Homo sapiens
ucugagauuuuuagauccuggcgcugcuauauagugauggacuuugagauuuuaga

SEQ ID NO: 2253643 - RNA, 74 nt, Homo sapiens
guaguuuaauuaggucccaugugucaauuuuaauuuuuguugaaauugcuuuugaagacuuagucauaaauuau

SEQ ID NO: 2253644 - RNA, 68 nt, Homo sapiens
ucucugcagaaaauggaguucuaaguauaguaacaauuuaguuacauaguuacuuccauuuccagaga

SEQ ID NO: 2253645 - RNA, 55 nt, Homo sapiens
uuggcgacugcugcuaaucagggcuucuuuauuuuccuggacagcuguuugccaa

SEQ ID NO: 2253646 - RNA, 125 nt, Homo sapiens
gccuuccaaagugcugggauuacaggcaugagccacugcacuuauccuccaauguuuuaauaaauaauaaagcauuuaggccggaugcagugucucaugccuguaaucccagcacuuugggaggc

SEQ ID NO: 2253647 - RNA, 102 nt, Homo sapiens
gaguacaacauuuauaaaugagaacugacucagacacauguauaugcuuguguauauguguguguguaugcaugugucuguguuuauguauguauguaucuc

SEQ ID NO: 2253648 - RNA, 59 nt, Homo sapiens
cagcucccagagugaccagcagagggcgcugggcccaacauggucaguucugggagcug

SEQ ID NO: 2253649 - RNA, 57 nt, Homo sapiens
ggugagagugugucagaggcugcgagggaccccuuuagccuuggacccgcucuggcu

SEQ ID NO: 2253650 - RNA, 77 nt, Homo sapiens
guauccccucagcuuuuguuugucuaagaaauauuuuguuguuucuucaugcuugaaauaauagcugugcaggguac

SEQ ID NO: 2253651 - RNA, 96 nt, Homo sapiens
ggaaaaggcaaugauuuuuuaaaauguuauuuuguguuagggcacagauugcugugaauaaaguaguaauagcagcuaagcaguuuuguuauuuuc

SEQ ID NO: 2253652 - RNA, 77 nt, Homo sapiens
guuucuggcauacaguagcuacucaauaacuauuucuggaauaaauaagugaauguuggcuacugaacacuagagac

SEQ ID NO: 2253653 - RNA, 74 nt, Homo sapiens
gagaugaacauaggauuuuaaguguuugauugugucccaauucacuuguggcagauccuuacagccaucauuuc

SEQ ID NO: 2253654 - RNA, 78 nt, Homo sapiens
ccaaaggguguggauguuuccuuauugauaucaucaaagaucuaguguaucaagaugacaaacuuugcucccuguugg

SEQ ID NO: 2253655 - RNA, 105 nt, Homo sapiens
ugaggcaggagaauugcuugaacccgggaggcugagguugcaguugcagugagccaagacugugccacugcacuucagccugggugacagagcaagacugucuca

SEQ ID NO: 2253656 - RNA, 58 nt, Homo sapiens
ugggaucaugagcaccgcuuccuucaccaguuuccuggaguaggugcucaagaugcca

SEQ ID NO: 2253657 - RNA, 64 nt, Homo sapiens
uucaguuugccaguauuuuauugaggauuuucgcaucaauguucauuagggauauuggccugaa

SEQ ID NO: 2253658 - RNA, 78 nt, Homo sapiens
agaaaucacaggguuauuguaauaauguaagggaguuacuuugcauuguucuugacagauaacaacuccuguauuuuu

SEQ ID NO: 2253659 - RNA, 76 nt, Homo sapiens
gugucuucuaagugacuagacuaugaaaccucuaacacucucaucagaguuaauucagagcuagucacuaaagcac

SEQ ID NO: 2253660 - RNA, 64 nt, Homo sapiens
auugugaauaaugcugcaaucaacauacuugugcaugugucuuuauagcagcaugauuuauaau

SEQ ID NO: 2253661 - RNA, 71 nt, Homo sapiens
agugggacugauaagagaugauuuugccaugagggcuucauccucaugaaugcaguaauguccuuaccacu

SEQ ID NO: 2253662 - RNA, 62 nt, Homo sapiens
gugaugugaggaaagagucuaauuuuauucuuuuggaauuggauauucaguuuuuccaucac

SEQ ID NO: 2253663 - RNA, 68 nt, Homo sapiens
gggcuuuguacuaauauaggcaaaaguugaugguaacaugaacuguaagguauaggugauaagagucu

SEQ ID NO: 2253664 - RNA, 55 nt, Homo sapiens
uguucuuacucauaugugggagcuaaagauauuguucucauggagggaaagagca

SEQ ID NO: 2253665 - RNA, 64 nt, Homo sapiens
uauuuauugaguuucuauuaugugccaggcacugugcuuggcacuggagauacauuaauaaaua

SEQ ID NO: 2253666 - RNA, 81 nt, Homo sapiens
agcuguauuacaaacaauuuguuucuaauaaugguuagaguacugacguuugcaaauuguuugguauaaauuagagcagcu

SEQ ID NO: 2253667 - RNA, 120 nt, Homo sapiens
acuaccaggagagauugggguagggcaggcugagaaauauacuacuccugugugcucgggaagaaaauauauugucucugccuugucuggacucucaguuuaccuucucuccucuguggu

SEQ ID NO: 2253668 - RNA, 116 nt, Homo sapiens
uaauuaaaaugugaaguacgacuuguuuauauucuuaugcuguuucugauuuagggaauaaacguuccaaucaagaccaagcauagaaauauggauauguuaauucuaaguaauua

SEQ ID NO: 2253669 - RNA, 63 nt, Homo sapiens
uugugccacugaagcccuccagguggaugccagggaauucuacuggggguucacaggguguga

SEQ ID NO: 2253670 - RNA, 91 nt, Homo sapiens
cuaagaauguuguaggagaugaugacaaccucauugucaccagguaaggugacuuuugaugguguuaccaucuuuacuagaaugcccuugg

SEQ ID NO: 2253671 - RNA, 62 nt, Homo sapiens
guguuccagucaucaucaauccgccagccagcgugugcagagcuugauaugauuaggagcac

SEQ ID NO: 2253672 - RNA, 89 nt, Homo sapiens
auugugaaguguacauguauauuuucugccuucaggaaucagauucuuugcuguaaacauagaauguaauguaccuccuuucaaacaau

SEQ ID NO: 2253673 - RNA, 117 nt, Homo sapiens
guuugcccuuccucagucauuuacaguuugccaugaugaaaugcauguuaaguccguguuucagcugaucagccugauuaaacacaugcucugagcagacuaaagcuaggggcaaac

SEQ ID NO: 2253674 - RNA, 73 nt, Homo sapiens
cuucuucguggauggcuguuccugggaguucuagcuccucacuagaugcucaugagucagccaguaugagagg

SEQ ID NO: 2253675 - RNA, 62 nt, Homo sapiens
ggcaugaaguagcccacaggcagcugcccuccagugggcagccugugguuuugcuuuuugcc

SEQ ID NO: 2253676 - RNA, 100 nt, Homo sapiens
cucugccugucucccaggcuggaguguaguggcgcgaucucgggucgcugcaagcucugccucccagguucgcgccauucuccugccucagccaccagag

SEQ ID NO: 2253677 - RNA, 106 nt, Homo sapiens
uccaucuauaauccgagggaagagagagagaacugauuggaguugggcauagaaucugaggaacgugcccacauccaaucaguucucucuuaagauuacagaugga

SEQ ID NO: 2253678 - RNA, 66 nt, Homo sapiens
ccacugggucugaaggacagagcaucaaaccaaagaggauuguucuugagccuuuagaccuaaugg

SEQ ID NO: 2253679 - RNA, 103 nt, Homo sapiens
aaguuugagguuuagggguggugagucaugcuggagucauggccugggcugggagaggcaccgccacuccagcagacugcucagaacucugucccuccagcuu

SEQ ID NO: 2253680 - RNA, 83 nt, Homo sapiens
guacucauuaaagcuagaauuguuccagcaaguucaaauuacauauuuguucaauguaaauaauuccuaggcuuuuugagugc

SEQ ID NO: 2253681 - RNA, 58 nt, Homo sapiens
guucucuaaaagaaacuuucaagacuuauauauaucuugaaaguguuuuaaagaggau

SEQ ID NO: 2253682 - RNA, 70 nt, Homo sapiens
gucugugaguauauuugcacuguuaugugccagcaacugugcacauaacaacugguaugaucaauaagac

SEQ ID NO: 2253683 - RNA, 72 nt, Homo sapiens
gucagcaaagaggaauaguuugauuucuucuuucccuauuuggaugucuuuuauuuauuucucuugccugau

SEQ ID NO: 2253684 - RNA, 98 nt, Homo sapiens
ggaugaaaacaggauuuucuuucacuugguggcaaaguuuauguuuguaucuuaaauuaagcuuuauagcauuaggauuauugagagccuacucauuc

SEQ ID NO: 2253685 - RNA, 58 nt, Homo sapiens
ucuggcgguuugcggccaaucuuggguuuuccuugucuuguagcagcauaaucccaga

SEQ ID NO: 2253686 - RNA, 71 nt, Homo sapiens
ugaccaaaaaugucacaaagauuguuuuggggugaggaaaaucuucuaaaacuagauugugaugaugguua

SEQ ID NO: 2253687 - RNA, 73 nt, Homo sapiens
cucagugcaauguuaauuacuugacuugcuuguagaaaguccucagucaauauuugacauuguuacugcuggg

SEQ ID NO: 2253688 - RNA, 64 nt, Homo sapiens
acaggaagaaagugcaguagauucucauuauucacaaguucuaaauuugcaaauucuucccugu

SEQ ID NO: 2253689 - RNA, 125 nt, Homo sapiens
aaaaagucuaaacuaugugaaggaagugguuuuacaaagagaaagaucaauugccuacacaauucaaauuuucuagugaauuuuuuaauuugugguuuacuuuauucauuuuggaguuacuuuuu

SEQ ID NO: 2253690 - RNA, 60 nt, Homo sapiens
ugugaauagugcugcaauaaacauacgugugcaugugucuuuacagcagcaugauuuaua

SEQ ID NO: 2253691 - RNA, 69 nt, Homo sapiens
ggugccugauuugugcuugauuugccuagcugggaauuucaguuuugcauuuaagacgacucccucacc

SEQ ID NO: 2253692 - RNA, 70 nt, Homo sapiens
uugcugguuuuaugauauuuaauuuuuaaacuagaaaauccugaucugagaaagugucauaacauagcaa

SEQ ID NO: 2253693 - RNA, 68 nt, Homo sapiens
ccugucugauguugaccucaaagccauaaauggguguuugcgacuucugaguuaaugucagcugcagg

SEQ ID NO: 2253694 - RNA, 109 nt, Homo sapiens
uucaaugaguagaagaguuucagguagaaagacccugggaccuggauucuggucacaggccugucucuuucuaacuuaagaccuuggaacaguacuuaaccucucugaa

SEQ ID NO: 2253695 - RNA, 74 nt, Homo sapiens
agggaacacuuuuacacuguuagugggaauguaaacuaguacaacuacuaugaaaaacaguguagagcuuccuu

SEQ ID NO: 2253696 - RNA, 114 nt, Homo sapiens
cuggaagacuucaggcaccagcagcucaguauuucucaagccuguugaaaccaccuuuauaaagauucugacagugagagaaaucugacauggcugacuccaucuugcuucuag

SEQ ID NO: 2253697 - RNA, 79 nt, Homo sapiens
uugcugcaguucuguaguugaaauuuaucuuuuaaaaucuguuagguuauguaguuuucugcucagaacucuccaguga

SEQ ID NO: 2253698 - RNA, 55 nt, Homo sapiens
cuacugauuaaaagaacaggucuagaaguaaccggccugaguuuaauuucaguag

SEQ ID NO: 2253699 - RNA, 64 nt, Homo sapiens
uuucuaaugcacugaaaaguaaugauuguaacuuguuaaaaauguugucagugcauuuaagaga

SEQ ID NO: 2253700 - RNA, 78 nt, Homo sapiens
uucagaucucuccuagaguacuuaccacagcauguauuacaugugcuguuugugggucacucuauugcuagacaugag

SEQ ID NO: 2253701 - RNA, 83 nt, Homo sapiens
guacagauguauuuugguuauccugucgguaauucaugcuagauaaucaugaacccagcaguuaaugaccucuacucugauac

SEQ ID NO: 2253702 - RNA, 68 nt, Homo sapiens
ucuccuugauuugggacuuaaugaaauuacauguuaaccaauugagucauuucaaauccaagaugaga

SEQ ID NO: 2253703 - RNA, 63 nt, Homo sapiens
cuauguguccauguguucucaucauuuagaucccacuuauaagugagaacaugugguauuugg

SEQ ID NO: 2253704 - RNA, 57 nt, Homo sapiens
uuacuugagaugaguuggacaaauuuugaauucaaaagcugucuaacuguccaguga

SEQ ID NO: 2253705 - RNA, 74 nt, Homo sapiens
ccuuauuuccaggaagauguguauuugcaaauguuuacuucuauuuggaacacauguuuuucuacccccagagg

SEQ ID NO: 2253706 - RNA, 87 nt, Homo sapiens
guacuaauauagcuauagauauguagauuaauuucugggcuuucuauucuguucucuugaucuaugugucuguuuuuaugccaguac

SEQ ID NO: 2253707 - RNA, 69 nt, Homo sapiens
gaggaggaggagggggaggaggaggaagaaucuguauuuucuugcuuguuguucccuucauuuuuccuc

SEQ ID NO: 2253708 - RNA, 64 nt, Homo sapiens
aguaucaugcuauuuugauuacuauaacuuuguaguauauuuuaaaguuagguaguaugaugcu

SEQ ID NO: 2253709 - RNA, 129 nt, Homo sapiens
ccagcaccugggguugggaagaugcucuccccacucucuuaggguacuuuggugcaucaacuggugcccccaugugguugcacccaggguccccaagaggcagagcucuccacacuugcguggggcugg

SEQ ID NO: 2253710 - RNA, 71 nt, Homo sapiens
gcacuguccuaguugaagaggcugucaucacuuggguuaagugugacagcacgguucaacugcugcugugc

SEQ ID NO: 2253711 - RNA, 92 nt, Homo sapiens
agacuggagacccagggaagagcugauuuuguugcaguucaaguaugaaguuaaucuuccaacagaauccucuuuuccugggaguauagucu

SEQ ID NO: 2253712 - RNA, 74 nt, Homo sapiens
ccuugaaguagguucucguaucgccgugcugauuuuagcacuggagcagggacgggcggguaacuugcugaagg

SEQ ID NO: 2253713 - RNA, 110 nt, Homo sapiens
aagcccugcccaagaagccacaacccagccccaguacaggcuccuuagauuuaucugcagcaaggauuuagggacaagggucugggguugaggcuucuagggcugagcuu

SEQ ID NO: 2253714 - RNA, 129 nt, Homo sapiens
ugaguugaaauaaucaauaguguuaagaugucuauuuucugcaggaaggaaauagacaguauuaauaacgaagucaauuuccuguaggaaggaaauagacaucuuaacacuauugauucuuucaauuaa

SEQ ID NO: 2253715 - RNA, 83 nt, Homo sapiens
ucuuucuaguugucuuuuaaagcuaaaauauguuuauuguaaauugaaaucaugagcagaugaguuuuaguagagcuaaaaga

SEQ ID NO: 2253716 - RNA, 60 nt, Homo sapiens
aaaccucugccuggaucucagacgauguauggaaacaccugaaugucuaggcagaaguuu

SEQ ID NO: 2253717 - RNA, 78 nt, Homo sapiens
cugccucauuuauggcccaugaccgcaacaggauacacucaccuauacugcuuaagggcaugggccccaccugggcag

SEQ ID NO: 2253718 - RNA, 73 nt, Homo sapiens
gacaucauagcacuuaccacaggcugcaauuaugcauuuguucauuuaguguguguguguguguguguguguu

SEQ ID NO: 2253719 - RNA, 57 nt, Homo sapiens
cucaccuugugauccacccgccucggccucccgaagugcugagauuacaggugugag

SEQ ID NO: 2253720 - RNA, 57 nt, Homo sapiens
aaagguaguacuucuagaagggaggcgaucagaguccaauuaggagauauuacuuuu

SEQ ID NO: 2253721 - RNA, 62 nt, Homo sapiens
uggggagaaagauguggaugacugccugccagggccccacccaccagcagcccauaucccca

SEQ ID NO: 2253722 - RNA, 72 nt, Homo sapiens
cucuauuggacagcacauaucuagaacauuuucaucauugcagaaaguucuguugauagugcugaacaagag

SEQ ID NO: 2253723 - RNA, 70 nt, Homo sapiens
ucuuuaaugagauuguuuguacuccacaguugacugacugucagaguauugaacagcucaucauaaaaga

SEQ ID NO: 2253724 - RNA, 80 nt, Homo sapiens
gagcuacacaccggccagguuucugcuagucauucggugaauguggaaugucugguagccaccuggagguuuguaugcuu

SEQ ID NO: 2253725 - RNA, 58 nt, Homo sapiens
gucucgaacucuggggcucaggcgaucugccugccuuggucucccaaaguguugagau

SEQ ID NO: 2253726 - RNA, 57 nt, Homo sapiens
uaccaggcauuuguaaugcugugccaguaugucugguucuuagcacagugccuggua

SEQ ID NO: 2253727 - RNA, 86 nt, Homo sapiens
ggccagugcagcaaagcgguugaaagugugcacuugaggaggcagcagagccugaguucaauuuccagcuguucuguuuacuggcc

SEQ ID NO: 2253728 - RNA, 70 nt, Homo sapiens
ucagugacagcaccuugacccugguaggcauucagaucagccucaacacauuagcaagugcuguuauuga

SEQ ID NO: 2253729 - RNA, 60 nt, Homo sapiens
uuuauccauucaccaguugaacauuugggcuauuugcaguuuuugguggucauggauaga

SEQ ID NO: 2253730 - RNA, 63 nt, Homo sapiens
uucaccggggaccccuggcugucucaugucucuaucaacuguagccagguuggccuuggugag

SEQ ID NO: 2253731 - RNA, 96 nt, Homo sapiens
gagguaaggaacuugccagaaguuaugcagcugaggguaguggagccaggauuugagcccaggcagccucacugcaguccuugaguuccuaaccuc

SEQ ID NO: 2253732 - RNA, 79 nt, Homo sapiens
aaccaggagaggggccagcuagaucauuucuagagauggaugagaaaugcauggacagcuggucuuuaacuucaugguu

SEQ ID NO: 2253733 - RNA, 93 nt, Homo sapiens
uaguuggcgcuauagacaaaaugguguuaguagaucuuuagaggacauuuuauuuaaugauugcagaauaccaucuuuuaugaagcacaacua

SEQ ID NO: 2253734 - RNA, 55 nt, Homo sapiens
uugagauggagucucacucugucgcccaggcuggagugcaguggcgccgucucag

SEQ ID NO: 2253735 - RNA, 99 nt, Homo sapiens
gagguggagucucacucuguugcguaggcuagagugcagugguaugaucccagcucauugcaaccucugccucccggguucaagugauucuccugccuu

SEQ ID NO: 2253736 - RNA, 69 nt, Homo sapiens
uacaagauaauagcacuguagauggaggaaagguguuagauuuuucucuuugcauagcuaugaggugug

SEQ ID NO: 2253737 - RNA, 78 nt, Homo sapiens
cauaaucccuacuuucaggcacuaugcugggugcugacauuacaguaaggcacauaggccuggaaaccaauuauugug

SEQ ID NO: 2253738 - RNA, 58 nt, Homo sapiens
auugaauguaugcuggguuuacugagugcaaaccacuguaguucacccugcauuuaau

SEQ ID NO: 2253739 - RNA, 72 nt, Homo sapiens
uauguaguuagaagauucaaacagauuucucuagaaaaagcaguaggguuauggaaacuucuagcuuacgua

SEQ ID NO: 2253740 - RNA, 75 nt, Homo sapiens
aagggaucacuuuuacacuguuggcaggauuguaaacuaguacaaucacuauggaaaacaguguggagauuccuu

SEQ ID NO: 2253741 - RNA, 75 nt, Homo sapiens
gcuucuuaagagaaaaaugcugacuaacccagugugaagaauucauucacauggaaaaguccaguaaaaagaagu

SEQ ID NO: 2253742 - RNA, 130 nt, Homo sapiens
agcauauaaaacacugcauaauguguaggugugcucuacuacaacaaauugaagauucugucaagaagauucugucaaaucuuauguuguagcagagcacacuuguacauuaugcaguguuuuauaugcu

SEQ ID NO: 2253743 - RNA, 76 nt, Homo sapiens
ccaggucacguugaggccagagcucccauggcuuugggcucccauggcuuugggcugcucugccccuauggcuugg

SEQ ID NO: 2253744 - RNA, 61 nt, Homo sapiens
cauauguagaagauugaagcuaggaucaaucaauugaagcuaggauuaauuuucauauaug

SEQ ID NO: 2253745 - RNA, 96 nt, Homo sapiens
gcagcuaugaguaacugggaagcacggaugagcugaugugaggguuuugugaauggucuucucauggaacaucuguacuggcuuagcagugucugc

SEQ ID NO: 2253746 - RNA, 102 nt, Homo sapiens
uuuguugauaaauuuuugguggcguagccuguaucaggacucaaguguuaaccuucaucaucaccggcagacuugaauaggcucaugcuuaucaucagcaaa

SEQ ID NO: 2253747 - RNA, 91 nt, Homo sapiens
gaguggagugucuauauuaggcaguggagaaauaaacaggccuccuucaggucgucguuuaguugucccuucuuaaagagguuuuccacuu

SEQ ID NO: 2253748 - RNA, 86 nt, Homo sapiens
ccccaauacaagcuauugaacuggauaaugagucagaaucuucccaugguauucguuggcuacuuguucauuucaucagccugggg

SEQ ID NO: 2253749 - RNA, 77 nt, Homo sapiens
auaggcuuauugauggaagcacauauagguacauagaaacaugguacguguauuguuuucacaagaagaugcucuau

SEQ ID NO: 2253750 - RNA, 97 nt, Homo sapiens
augacacuaaguucuaggguacaugugcacaacaugcagguuuguuacguauguauacuugugccauguugguauguugcacccauuaacucgucau

SEQ ID NO: 2253751 - RNA, 56 nt, Homo sapiens
aguuuuugcugauagcaugcuuacgugguaguguagcuuacugggcaguaaagauu

SEQ ID NO: 2253752 - RNA, 119 nt, Homo sapiens
gugugcaugcaauaaauacauuauauauuuuuucuggcaauaggcagugucccaauaguaacacccuguugugcucuuauugugcagggaauauauuauuugguuaauuauuagcacac

SEQ ID NO: 2253753 - RNA, 75 nt, Homo sapiens
cagguuaaaaugugcuuugaaaagagcugaaauaauuuuaguuuuacuuuauuuggagacauuagcaaauaccug

SEQ ID NO: 2253754 - RNA, 73 nt, Homo sapiens
acaggaagaccaugagcugguccuuuaaggaugcaaccugggaguugccccgaggacugugcucacauucugu

SEQ ID NO: 2253755 - RNA, 57 nt, Homo sapiens
augcacuguaauagcucagaaggagcuuucagagcauuuaugagcuaugacaugcau

SEQ ID NO: 2253756 - RNA, 98 nt, Homo sapiens
uuuggauuggcauuucucugaugaucaaugaaguugagcaccuuuucauaugccugucugccauuuguaugucuucuuuagagaaaugucuauucaaa

SEQ ID NO: 2253757 - RNA, 64 nt, Homo sapiens
gcaugcgggccugggcuuggcagggucccaucauucuuuuuucugcagccauucagcccuaugc

SEQ ID NO: 2253758 - RNA, 70 nt, Homo sapiens
agaacacuaguauuccuuuugcauuuccacauagcuauagagugagaagauaaggggauaauggcguuuu

SEQ ID NO: 2253759 - RNA, 74 nt, Homo sapiens
ucuuuuggcuuacaguucugguggagagguaagugaaguuuaccaaagcagugaauugucauuaagcuagagga

SEQ ID NO: 2253760 - RNA, 60 nt, Homo sapiens
guucuugcucauggcagaagugaauagggagcaggcucaucacauggccagaguaggaac

SEQ ID NO: 2253761 - RNA, 74 nt, Homo sapiens
guuucuugaaaaguuguugaaggcuucacggagggaaaaaaaauggagcauucuaacaacuuugcagaugagac

SEQ ID NO: 2253762 - RNA, 59 nt, Homo sapiens
uugaccucaucacuucccaaaggccccacuucccaucaccguggggaggaggaugucaa

SEQ ID NO: 2253763 - RNA, 86 nt, Homo sapiens
ucucauucuggcaagagccgagggcaguuggguccauugaaccuguuacaucuaagcccgagucuuccagaaaauucuuauugaga

SEQ ID NO: 2253764 - RNA, 56 nt, Homo sapiens
guuuaauuauagcagggucauugauaguucguggugaucauuguuguggguugaau

SEQ ID NO: 2253765 - RNA, 78 nt, Homo sapiens
gguuuggguaagucagauuuacaaugucagccaucaucuggccauguuugaaagucuaggcuuacaguaaugcaagcu

SEQ ID NO: 2253766 - RNA, 59 nt, Homo sapiens
auguauuaugugguugggagaauaauuucuguccccauucucccaagaugcucauacau

SEQ ID NO: 2253767 - RNA, 112 nt, Homo sapiens
ccagucaccauucacauuuuuaguucuaugcuagaugcuguagggauuuaaaacaauucauugucuaagccuucaagauguuuagucuacauaaaauuaaacuaaugacugg

SEQ ID NO: 2253768 - RNA, 99 nt, Homo sapiens
gggaucagaagccagggaacuuugcaauguugugauggugaaauauggguuaauuauauuugcuucaauauauuuucagaauuccacgugcugauaccc

SEQ ID NO: 2253769 - RNA, 81 nt, Homo sapiens
guagaccaccugcgauauggugaguaauaucacccuccucuccuucccuggauauuacagaccauaucgccggggguguac

SEQ ID NO: 2253770 - RNA, 127 nt, Homo sapiens
ucauuguuggauauuuggguugguucuaagucuuugcuauugugaauagugucacaauaaacauaccugugcauaugucuuuauagcagcaugauuuauaguccuuuggguauauacccagcaaugg

SEQ ID NO: 2253771 - RNA, 115 nt, Homo sapiens
aagaugaaaucuuacaagucuuuuucaugucuucugagggcugagauauaacuuugaaguagagcccaaacaugaagaucaugaagacggcuucuucuccaaaugauguuaucuu

SEQ ID NO: 2253772 - RNA, 89 nt, Homo sapiens
gaaggcaguggugaaggcagcgguggcugcuacaucaguaaagcucuuggcuuauuauuagucggccagcuguuaaacuauuuucuuuc

SEQ ID NO: 2253773 - RNA, 66 nt, Homo sapiens
cuucaaguguggccaccugaccagcucccaagacaacacugcuugucaggggaccauacauugaag

SEQ ID NO: 2253774 - RNA, 56 nt, Homo sapiens
gucuguguuccaccuuuacugucaaaaauuaugcuggugagaaaggagacauagac

SEQ ID NO: 2253775 - RNA, 61 nt, Homo sapiens
gaaucugaaucugauaccacaagcucuacccacuugccuuuggucccuucagaucggauuu

SEQ ID NO: 2253776 - RNA, 84 nt, Homo sapiens
uggguauuugagauguggcaguuuaugaggucagaugguaacgauuucuggcucucaguugauuugcuauauuuuucugauuca

SEQ ID NO: 2253777 - RNA, 97 nt, Homo sapiens
uugaaaauguaagagcauaaaagcuggauuucgcauccuguuaggguauuuuugguccuaucagagaugggaagucagcuaauaauugcauauuuag

SEQ ID NO: 2253778 - RNA, 61 nt, Homo sapiens
gacagaaaagaucuccuuuguuaguugcaaaacaaguaagagagcuccaucuuuuccuguc

SEQ ID NO: 2253779 - RNA, 82 nt, Homo sapiens
cacaaugugguugaaagagcauggacuugaaauucaggcuggucugguucaagucuuggcuuugccaccuacuaaccaugug

SEQ ID NO: 2253780 - RNA, 80 nt, Homo sapiens
cuagggugauuuuauuucuaaugucacaguguguguacaccauguguauacacccugugauauuauucauaguauccuag

SEQ ID NO: 2253781 - RNA, 61 nt, Homo sapiens
acagcaauauaaauguacuuaauagacuuaaacaugguuaagaugguacguuuuguucugu

SEQ ID NO: 2253782 - RNA, 74 nt, Homo sapiens
ggucaccaggugcuuuucagaagcuguugaccguaauucucuagcaguacauaaaaagcauccuggucuuggcc

SEQ ID NO: 2253783 - RNA, 84 nt, Homo sapiens
caaaacccuucaguggcuccucacugcccugaggagaaacuccaagcuucucagcacagucagggcgccuccuggucagcuuug

SEQ ID NO: 2253784 - RNA, 75 nt, Homo sapiens
accuaggccagccucagcugggaugauuagguucugcccaguggguccuucauccuccagcaggcuagccugggu

SEQ ID NO: 2253785 - RNA, 113 nt, Homo sapiens
uugcaauucuacuguacccuucauuauucaccuacuuuugccauguguguaaggguauaauuuugcauguacguacagagagagugaguguuaaagggauagagggacaguga

SEQ ID NO: 2253786 - RNA, 57 nt, Homo sapiens
ugagacggagucucgcucugucaccacgcugcagugcgauggugcgaucuccgcuca

SEQ ID NO: 2253787 - RNA, 88 nt, Homo sapiens
gccacccauuugugcacagaugaggagaggucucaugaagcuucagugcagucugggaccuuagcucauuuguaacaaguuguuuggc

SEQ ID NO: 2253788 - RNA, 56 nt, Homo sapiens
gagaggucguauaugauuucugguuucaaauaccugaagaagucauuagacuuuuc

SEQ ID NO: 2253789 - RNA, 71 nt, Homo sapiens
ccgcagggaccuugcugcggcgguggcaucuuccucccaggcgaugaccagagagugcgcaggguccgcgg

SEQ ID NO: 2253790 - RNA, 87 nt, Homo sapiens
aguuuuaccaaaccauccuuagaguacaggggaaucaaggaugaauuugcccaacuuuguucacuguucuuuacuuggggucagacu

SEQ ID NO: 2253791 - RNA, 130 nt, Homo sapiens
gggcccggagggcagcucacugggguugaggcugugaggcacugcugcuuuccaggagaacgaacucagcacacagucuggggcagacaguccuucagcucuucucacuguguguuucucuucugggucc

SEQ ID NO: 2253792 - RNA, 89 nt, Homo sapiens
uguggggauggcaugaccuuguccucagugucauccagaaaggaugagggggacaggugucauagcaggaguauuaguucauucucaca

SEQ ID NO: 2253793 - RNA, 130 nt, Homo sapiens
ugaauuuuagauuaugccaagguaggauauuuaugaaauagaaaauugucauuuuucagugguucgaaccauuucuagcccugagauaaaugucauagucugaaaauuuuacuuuauuaaucuauauuua

SEQ ID NO: 2253794 - RNA, 102 nt, Homo sapiens
gucuuggcuaugucuuuauagcagugugagaauggacuaauacaacuaguauguucauugcagcacuguuuaugauacugaagacauggagucaaccaagau

SEQ ID NO: 2253795 - RNA, 86 nt, Homo sapiens
gucugagggggaucuuguggugcuuuuacgugggccugccauggcugcccauguaacaaucagcaugcccuuccccgcucugaggc

SEQ ID NO: 2253796 - RNA, 77 nt, Homo sapiens
ucgcuugaacccaggaggugaagguugcagugagccgagaucaugccauugcacuccagccugggugacaagaguga

SEQ ID NO: 2253797 - RNA, 68 nt, Homo sapiens
ggguacaugugcacaaugugcagguuuguuacauauguauaaaugugccauguuggugugcuguuccc

SEQ ID NO: 2253798 - RNA, 97 nt, Homo sapiens
uuuguuccuucuaaggauuccagugagggaguuggguguauaggaaggaaaucuuauuguccaaguuucccuuugaaaccucuuagaauggaauaaa

SEQ ID NO: 2253799 - RNA, 92 nt, Homo sapiens
ggcagguuuuaguagcugcaucagagccugugugcccugaaaagauguuugcaggccucacgggcucugggucuugacggaagauguuugcu

SEQ ID NO: 2253800 - RNA, 67 nt, Homo sapiens
cugcauuaauuaaacuauuucccuacugcaauacugcugucucagugaauugguuuuaucugugcag

SEQ ID NO: 2253801 - RNA, 60 nt, Homo sapiens
ugugaauagugccacaauaaacauacaugugcaugugucuuuguaguagcaugauuuaua

SEQ ID NO: 2253802 - RNA, 95 nt, Homo sapiens
aguuuacuauaccuuugguuaauccugccuuauuucaguaaagaaaauuuguacuggaauaacuuguagugguuucuaagaauaaauaguaagcu

SEQ ID NO: 2253803 - RNA, 56 nt, Homo sapiens
cccgggagguggaaguugcagugagcccagauugugccauugcacaccagccuggg

SEQ ID NO: 2253804 - RNA, 59 nt, Homo sapiens
uccagggagaguggugcugccucagaacacaaagaugagaauguagggcucucccagga

SEQ ID NO: 2253805 - RNA, 66 nt, Homo sapiens
guauuucuaguucuagauccuugaggaaucaccacacugucuuccacaaugguugaacuaguuuac

SEQ ID NO: 2253806 - RNA, 56 nt, Homo sapiens
agacacuggguguuuguuggcguucgggcugccagggccaucgaauccgguugucu

SEQ ID NO: 2253807 - RNA, 67 nt, Homo sapiens
ucuugguuauggaaggcugugguuggccuuguaacaaccugcaauaauugcaccaucuagaucaaga

SEQ ID NO: 2253808 - RNA, 76 nt, Homo sapiens
uggcuugagccugggaggcagagguuucagugaguugugaucaugccacugcacucuagccugggcaauagagcca

SEQ ID NO: 2253809 - RNA, 57 nt, Homo sapiens
uacauucugugacaugcgcuguuaagaaauuucguugugcaaacaucauagaaugua

SEQ ID NO: 2253810 - RNA, 63 nt, Homo sapiens
acauggauuuuggggccagaggcagaaugcuaugguuugaauguguccucccaaaguucaugu

SEQ ID NO: 2253811 - RNA, 56 nt, Homo sapiens
ugagcuaggaucacaccugcauuccagucugggugacagaaugagauccuaucuca

SEQ ID NO: 2253812 - RNA, 61 nt, Homo sapiens
uggaaaauuaggggagguuauacuauaaaauauuaacaguguaggaaauccuaguuaucca

SEQ ID NO: 2253813 - RNA, 99 nt, Homo sapiens
gaggcaggagaauugcaugaacccggcaggcggagguugcagugagcagagauugcgccauugcacuccagccugggcgacaaagcaagacuccgucuc

SEQ ID NO: 2253814 - RNA, 96 nt, Homo sapiens
uuguaagugugcguucugggagcaucaagaccauccaagauucaggugaucccuggauggagaggcuugugaugccugggaaguguguguuaacag

SEQ ID NO: 2253815 - RNA, 96 nt, Homo sapiens
uuagcugucaggcaugauggauucaggaguaaaaagugaugcugugaagacaucaccuuucccuuucugaaucuuacuugccuuugaguuaguuaa

SEQ ID NO: 2253816 - RNA, 66 nt, Homo sapiens
ucgagaugaucaugugguuuuguccuuuauucuauuacuagggcaaauuauacugauugauuuuga

SEQ ID NO: 2253817 - RNA, 64 nt, Homo sapiens
gcccuaaaguagaauaaccuuuucuuucuccaugaauggaauguaaguuauguuugcugagggc

SEQ ID NO: 2253818 - RNA, 81 nt, Homo sapiens
gggauuacaaacaaauuuuuagcaacuagguagguuucacaaauauggaaucugcaaauaaugaagauuggcuguaauucc

SEQ ID NO: 2253819 - RNA, 80 nt, Homo sapiens
gacuugucuguguauuacuugucugugucucaauuuccucaucuucuaaaaugagaauacagcaguaaccacuggcaguu

SEQ ID NO: 2253820 - RNA, 76 nt, Homo sapiens
agguucgugcaaacguaauugugguuuuugcaucugaaaguaauggcaacgaccgcaaauacuuuuguaugaaccu

SEQ ID NO: 2253821 - RNA, 59 nt, Homo sapiens
ugugauugcuaacucuauguuuccauuuuccauaaugugaccuguaguaagcauucaca

SEQ ID NO: 2253822 - RNA, 91 nt, Homo sapiens
ucccagaggcuugaaguaggaaaggaggagguaagauuugccuuuuucuuccauucuccaccucuugccucacuugcuagaugcucugggg

SEQ ID NO: 2253823 - RNA, 56 nt, Homo sapiens
uugguccauauuugguugaauccauggguauggauaucacagauauuaugggccaa

SEQ ID NO: 2253824 - RNA, 66 nt, Homo sapiens
agucauaggagagauaucacugugugauugauuaucacaaauuguauagaugauaauuccuagacu

SEQ ID NO: 2253825 - RNA, 130 nt, Homo sapiens
aaaggaaagggcagggugcccugacggaggucagggccuuccuggcggccccuucgcccgacaugggguggucguggagucccuggcuuccacccaaggugcgugucuccugucaaauucaucccaacgu

SEQ ID NO: 2253826 - RNA, 72 nt, Homo sapiens
gccagcccccuuagagcagcuauggaaggagacuacacagcuacaucuugcucugggaugccuggggcuggc

SEQ ID NO: 2253827 - RNA, 97 nt, Homo sapiens
ggaguucuguuguguuugaugcugacacgcacccaggcauaauucuuucugcuagacugcccccugcugucugcaacaguacuacaacuagaauucu

SEQ ID NO: 2253828 - RNA, 60 nt, Homo sapiens
uccacuggcucccaagguuaucaagagugugcucugcuuuaacccugaaggagcucugga

SEQ ID NO: 2253829 - RNA, 87 nt, Homo sapiens
ccagcguugguuuggcaugaagaccccauccuuucaauguagauuauuaaaggucauuuucuucugcugcaaugaacccagcguugg

SEQ ID NO: 2253830 - RNA, 86 nt, Homo sapiens
auaagacugaaucaguaauaaaaagucucucagcaaggaaaaacucaggaugagauggcuuuauugcugaauucuaccaaacuuau

SEQ ID NO: 2253831 - RNA, 95 nt, Homo sapiens
gcuuuucccuguuuccuacuuuacuguacuguucuggaaguauaaggggaaaacaggaagaugguacuggguaaaaguggggaucagggaaaagc

SEQ ID NO: 2253832 - RNA, 73 nt, Homo sapiens
uucucagguauagauaaaucugugugauauggauguuuaagaauaaauaucacagcauugucuauaauaagaa

SEQ ID NO: 2253833 - RNA, 123 nt, Homo sapiens
agggaguagccucugguccuuuuguuacuuaggcuuggaaaguuaggguuuuccuuucaauuuaguuuuaggaaguuggcgugaaacagccuuacauucccugccuccagacccuauucuccu

SEQ ID NO: 2253834 - RNA, 86 nt, Homo sapiens
gggucacuguaugguaccagugucagcuuccuguguuacacgagauggcacaguugggugaagcuggugaugaagguaugugaccc

SEQ ID NO: 2253835 - RNA, 78 nt, Homo sapiens
aaucuuucuaacaacuaguuuuaauguucauggguacauuuuaccuaagguacuguuaacauuguauagagaaagauu

SEQ ID NO: 2253836 - RNA, 68 nt, Homo sapiens
aggaggaacucagauacuggugacaugaauguguugugcuuauucugugcuccaugucucaaccuccu

SEQ ID NO: 2253837 - RNA, 89 nt, Homo sapiens
cagugcucuaaccauaaaacuacaucguuaauuuauuuucagcuacaauuaacuuaaauucaaugaaugaugguugguauggugcgcug

SEQ ID NO: 2253838 - RNA, 108 nt, Homo sapiens
ucaucugagaacuuguuagaaauacacauuccugggccucaccccgaucuacugaaucagaaacugguggggcccagcaaucugcgauuuaacaagucuucuggauga

SEQ ID NO: 2253839 - RNA, 59 nt, Homo sapiens
uauggaaguuagggaugaauaaagugucaaggaugacucuuugguuucugacuugcaua

SEQ ID NO: 2253840 - RNA, 104 nt, Homo sapiens
gaggcaggagaaucgcuugaacccuggagguggaggcuguggugagcugagauugccccauugcacuccagccugccugggcaacaagagugaaacucugucuc

SEQ ID NO: 2253841 - RNA, 74 nt, Homo sapiens
ggagagaagagaugcagccacucagggagcccagaccugggagcuccccgagcccaggcugugacucccucuuu

SEQ ID NO: 2253842 - RNA, 56 nt, Homo sapiens
uugagauggaguuucacucuugucacccaggcuggagugcaauggcaccaucucag

SEQ ID NO: 2253843 - RNA, 80 nt, Homo sapiens
gaauaucacagaagugauguuauguucuucucuguauaucacauaucagacaucaacauggcuuauuacuggugcuguuc

SEQ ID NO: 2253844 - RNA, 67 nt, Homo sapiens
ggcucagaauuggggaaugguggcuuuagugccauguauuugcuauccauacccuacuucacaagcc

SEQ ID NO: 2253845 - RNA, 63 nt, Homo sapiens
guuugguucagguaguuuuggaguggcagugaguuaguccacuucaucagccagaaaucaagc

SEQ ID NO: 2253846 - RNA, 63 nt, Homo sapiens
uaaggaggcugcugugaagaaaggacaugcaauuccuccugccaucacacuguggcuucuuua

SEQ ID NO: 2253847 - RNA, 56 nt, Homo sapiens
ggagguagagguugcagugagcugagauuguguuauugcacucugaucugcacucc

SEQ ID NO: 2253848 - RNA, 82 nt, Homo sapiens
gucccugcuucuuccuuaguuauuugguccccuccuccucccagcaggauuaggguaggaacugaguggaagggcaggagac

SEQ ID NO: 2253849 - RNA, 109 nt, Homo sapiens
ucagguccuguccccagaauaagagcuuggguuaaaguugccuuucugggcgcuguucccagaauaagagcuucuuaacaacaagcuccauuucccuuuaaugaccugg

SEQ ID NO: 2253850 - RNA, 86 nt, Homo sapiens
uaaguucuaggguacaugugcacaacgugcagguuuguuacauauguauacaugcgccauguuggugugcugcacccauuaacuug

SEQ ID NO: 2253851 - RNA, 77 nt, Homo sapiens
ucaccugauccugggaggcagaaguugcagugaacugagauagugccacugcacucuagccugggagacaagaguga

SEQ ID NO: 2253852 - RNA, 84 nt, Homo sapiens
gauggggaacucaagaagcaguguucaagaagaagagaugggugcaauacuaugucuagaaaagccugccuucuugagcucauc

SEQ ID NO: 2253853 - RNA, 130 nt, Homo sapiens
aucguccuugccacagcagccuccccuucacuccugcuugccacagaugguguccucccuuccagggcucuugcaguguucugggcaggaagaaggagaggggaaagggcugaaucccagcaagggacuu

SEQ ID NO: 2253854 - RNA, 65 nt, Homo sapiens
ggauucauggaaggucagaugcagaacuucaccccuucaacucugugucccaaccccauggguuc

SEQ ID NO: 2253855 - RNA, 85 nt, Homo sapiens
uaugcuauuuuuaccaguucuaugccaaguucuauauagaagaucuuguauagcccuugguguggaaaugguaaaaucaggcaua

SEQ ID NO: 2253856 - RNA, 58 nt, Homo sapiens
aguggugucuuuuuugauuaggagaaacauuucuucuaguuauagaaaaagcauuauu

SEQ ID NO: 2253857 - RNA, 67 nt, Homo sapiens
gguuugugcaaguguaauacagcuaggcuccuuugauucuuagcuguucugcgcucuggaaaaaacc

SEQ ID NO: 2253858 - RNA, 103 nt, Homo sapiens
ggccucugcacgugccucccuguggcuagaaugaagguagcugaacuagaauuaugucugaaucuucuagcuuuccuuuuggccaggcugccacccagaggcu

SEQ ID NO: 2253859 - RNA, 82 nt, Homo sapiens
uccacguuuaugaaguacaguacugaaugaauguauggugcaguaaugaauauacaaaguacaguacaguaaugaaugugga

SEQ ID NO: 2253860 - RNA, 129 nt, Homo sapiens
ugcuguguccacucaggguuaaauggauuaagggcggugcaagaugugcuuuuuaaacagaugcuugaaggcagcaugcucguuaagagucaucaccaaucccuaaucucaaguaaucagggacacaaa

SEQ ID NO: 2253861 - RNA, 77 nt, Homo sapiens
gugggagaagugcuuguacaaaccccgaggauaauagaugugauccugccuuguaaauuguaaagcacuguguccac

SEQ ID NO: 2253862 - RNA, 58 nt, Homo sapiens
gcuagagccugugccuucuagggaccugugugagccagacuagagcacaagcuuuggc

SEQ ID NO: 2253863 - RNA, 92 nt, Homo sapiens
agacagucgcuugagcacaggauggggagguugcagugagcugagacugcgccacugcacuccagccugugcguaagagugagaccuugucu

SEQ ID NO: 2253864 - RNA, 93 nt, Homo sapiens
aguucuuaaaugaaagaaugauauagauggcuuucaaaaacgaguugaguucucuugauaguccuguaucuauuuuuucaaguugauugagcu

SEQ ID NO: 2253865 - RNA, 74 nt, Homo sapiens
gagcaauuauuuauggagauccucugcgggcaaagaugaagcugucuuccucuggggaggauuuauauuugcuu

SEQ ID NO: 2253866 - RNA, 61 nt, Homo sapiens
augacuaaaggguuuauguugaagcuacuuaauguguauguguaguaggcccuuuguuuau

SEQ ID NO: 2253867 - RNA, 72 nt, Homo sapiens
uccuuugucagagcacugaguugugggccuuuuccgguaaggcccuuauaaaauguguucuguuuugaagga

SEQ ID NO: 2253868 - RNA, 76 nt, Homo sapiens
ggaggcugaggugggaugaucgcuugagcccaggaggucgaggcugcaguggguugugaucgugccccuacacucc

SEQ ID NO: 2253869 - RNA, 74 nt, Homo sapiens
cuuuugaaaacugcugggcuauuacuuacacacauuaaacauaugccuacugaugacccugcaguucucaagag

SEQ ID NO: 2253870 - RNA, 64 nt, Homo sapiens
auugugaauggugccgcaauaaacauacgugugcaugugucuuuauagcagcaugauuuauaau

SEQ ID NO: 2253871 - RNA, 64 nt, Homo sapiens
auugugaaugaugccgcaauaaacauacgugugcaugugucuuuauagcaacaugauuuauaau

SEQ ID NO: 2253872 - RNA, 81 nt, Homo sapiens
gaauaauucuuuaucuagguauaggauucuagguuggaaaucauauucccuuagaauuuuguaguuauugaucuauuguuu

SEQ ID NO: 2253873 - RNA, 64 nt, Homo sapiens
guagaacuugaaugccaauaucuccuucuuguccaggagguagaacauugccauuuacaucuac

SEQ ID NO: 2253874 - RNA, 55 nt, Homo sapiens
cacauuuagaguucuuuacuccaguaugguaccguauggaauggauuuaaaugug

SEQ ID NO: 2253875 - RNA, 68 nt, Homo sapiens
uucuucuuaauguccugggaacuaucugugcagacuaagaauaauuuguuccuuaggcauuggaagaa

SEQ ID NO: 2253876 - RNA, 82 nt, Homo sapiens
gugcucuuuuucuugauuaguuuuaccagaggacagucagauuauuggccuuuuccaagaacuacuauucagaagaaaguau

SEQ ID NO: 2253877 - RNA, 64 nt, Homo sapiens
cacucugcacuuugauuuggagcauguggaugugcgagugucaagaaaucaaggugugagagug

SEQ ID NO: 2253878 - RNA, 57 nt, Homo sapiens
ggguucuuugcaggaccaaccccugcauaagggauucuggugucuuggaaagagcuc

SEQ ID NO: 2253879 - RNA, 57 nt, Homo sapiens
caaaggcuucugaaacugcagagauaucauugcuaugcaagaaacccagagccuuug

SEQ ID NO: 2253880 - RNA, 67 nt, Homo sapiens
ugggcaaggaugagugcccaugagaucugcuucuuuaaaggcgucucucucacuccuccucgcgcca

SEQ ID NO: 2253881 - RNA, 77 nt, Homo sapiens
aaugcagcuggcaagugucugagguuuuguauuagcccacaaagggcauaauuaucucagacacuuguuuauucauu

SEQ ID NO: 2253882 - RNA, 57 nt, Homo sapiens
gaggaggauuugagaggagacaaaagagaaaucuguuagcuugucaaaucuuuccuc

SEQ ID NO: 2253883 - RNA, 82 nt, Homo sapiens
gcagacuucaccuguguggcuggcgcgugacaccacuguagaagcucagugcguucauuuggccaguggcgaguguaguugc

SEQ ID NO: 2253884 - RNA, 84 nt, Homo sapiens
acaguccagcuuuagugaguguggagcuagacucugaucuggauuugaauucugguuccugcauucauucaacuguguuacugu

SEQ ID NO: 2253885 - RNA, 124 nt, Homo sapiens
guucuggguauagucugcaguccagagugagaacuuauggugauuuuuucaggccugucuauggccucccaaagaccagucagcaugagcuuccucccuucugagcccauaaagaccccagaac

SEQ ID NO: 2253886 - RNA, 68 nt, Homo sapiens
guugcuuuccuggaagcacaacgcauuuauuugacaagaguauuugauacagucuucuaggaggcggc

SEQ ID NO: 2253887 - RNA, 130 nt, Homo sapiens
ucauuuacuaguauauauugauuuuucuaugcugaucuuauacaucgugauuuugcugaauguguuuauucaucaucacaguuguguguaauguuguaugaguguguaucaauagguauuuuaugaauga

SEQ ID NO: 2253888 - RNA, 86 nt, Homo sapiens
guuguagcaguguacaccuguggucccaguaacuuggcaagcugaagugaaaggauugcuugaaccuaggaguucaaggcugcaau

SEQ ID NO: 2253889 - RNA, 66 nt, Homo sapiens
cuaccuaaaugucucuacuaaguuuagggcugguccuggaaauugggguagaggguuugcaugugg

SEQ ID NO: 2253890 - RNA, 56 nt, Homo sapiens
uucuccucuuuggacucguugaccuuaguuaaugaugucauagucuaagaugagaa

SEQ ID NO: 2253891 - RNA, 91 nt, Homo sapiens
aguguuagucaaaggguauaguuucuguuauacggcacaaauaagucccagcgagcuacugaacagcauaguacccgugauaaauaacauu

SEQ ID NO: 2253892 - RNA, 81 nt, Homo sapiens
ggucacaaaucccacggaggaaggacugagaaugcacaccuguagugguguugcagaguucuuccuccugaggaccuggcc

SEQ ID NO: 2253893 - RNA, 64 nt, Homo sapiens
uugagugguaguuucuagagguguuauuuccaauauguuaaaguuuuagaauacuacuauuuga

SEQ ID NO: 2253894 - RNA, 86 nt, Homo sapiens
ggggauggagugggaagguggucuuccccuggaguucggccaucugcggcugaacuccuccgaagucgcacugucaagccaucccu

SEQ ID NO: 2253895 - RNA, 107 nt, Homo sapiens
cuggagcggaaggugugggaacuggcgaggcuggucuggcagucuuccagugugguguuccacacgggugccggcaucagcacugccucuggcauccccgacuucag

SEQ ID NO: 2253896 - RNA, 85 nt, Homo sapiens
guggaaggugugugacaggagguaggaauaaacauuugaaauuaaguuucauauuauuuaucucaugaguaucaauuucauccac

SEQ ID NO: 2253897 - RNA, 77 nt, Homo sapiens
ugacaaacauuggucugucuaugauaaagcuguuguaaacauccaaguacaggugcuuauguggacauauguuguca

SEQ ID NO: 2253898 - RNA, 91 nt, Homo sapiens
cuccagccucaggccccuccgcacaggcaccgcagggcuccuccacccccggaggaucugguguccucgugggagucccuuggggcugggg

SEQ ID NO: 2253899 - RNA, 122 nt, Homo sapiens
ggaagaggaugguggccagggguggcauuggcagccacagagagugcuuggcaucugcugacgggccguacgguggauccuggacacucuuggucuacccccacgccacccacacugcuucu

SEQ ID NO: 2253900 - RNA, 75 nt, Homo sapiens
gcuuggugcucaaggaaauuuguaaaaaagaacaggaggccuuauugcaaacuuccuugggcagcauuuuagagc

SEQ ID NO: 2253901 - RNA, 55 nt, Homo sapiens
ugcugguauuauguuauccagaagucucuauuuucuucugucauggcaaccagca

SEQ ID NO: 2253902 - RNA, 59 nt, Homo sapiens
gagucacaaaaguuaauucugaugaagucuguuucauccaguguuuucuuuugucacuu

SEQ ID NO: 2253903 - RNA, 57 nt, Homo sapiens
ucgcaguuaauaaugaugugcgcuauaaagacacaugcacauguauguuuacugcgg

SEQ ID NO: 2253904 - RNA, 80 nt, Homo sapiens
guccauuuuacugaugagaaaacuaaggcacaaagaaauuaaggaacuugccugagaucauacuguuaguaaguaaggac

SEQ ID NO: 2253905 - RNA, 65 nt, Homo sapiens
uguccccgaggcuggagugcaguggugugaucuccgcucacugcaacguccaccucucagguuca

SEQ ID NO: 2253906 - RNA, 58 nt, Homo sapiens
aacauggaagccagagagagcuucuuacauguaagucaguucacauggcuccuguguu

SEQ ID NO: 2253907 - RNA, 116 nt, Homo sapiens
cuaugugauagcuuuaagguuggugcaaaagugauugcgguuuuugccauuacuuucgauggcaaaaccugcaauuacuuuugcagcaacuuaauaaauaacaaagaaacauguag

SEQ ID NO: 2253908 - RNA, 58 nt, Homo sapiens
cuaaaguauugagugguaaagaggcgugacucaugcaacuuacuguccaaugguuuag

SEQ ID NO: 2253909 - RNA, 59 nt, Homo sapiens
gaucccuggucaaagcaugcaauauauuaucuaauaguguggcuuuguaaccauggguc

SEQ ID NO: 2253910 - RNA, 77 nt, Homo sapiens
gucagugguucuaaaccuuuuuuggucguggaaaauucagugggguccacaaccaaagaagguuaagaaccacugac

SEQ ID NO: 2253911 - RNA, 66 nt, Homo sapiens
uuucucagcagauggccuuagcuaugaagaauauguuaauccaugaaugagguauuuguugggaga

SEQ ID NO: 2253912 - RNA, 87 nt, Homo sapiens
ggagaaucacuugaacccgggagguggagguugcagugaguagagaucgcaccacugcacuccagccugccgacagagcaagacucc

SEQ ID NO: 2253913 - RNA, 104 nt, Homo sapiens
auaugaacacagguaugcacaugcaugcuugaauaucugagugcauacaugcuuggauaucuaugaauguaugugcaugaaucaagucucuucugugugcaugu

SEQ ID NO: 2253914 - RNA, 68 nt, Homo sapiens
agaaggaaagggaauucuaucuuguuuaagucucuucuugaaauggaagaagucccuuuuagcuuucu

SEQ ID NO: 2253915 - RNA, 73 nt, Homo sapiens
gguuuguuacauagguauacaugugcuguggugguucacuccaucuaucaaccuguaaucuaaguuuuaagcc

SEQ ID NO: 2253916 - RNA, 56 nt, Homo sapiens
gggagaagaugguuaucuacaagcuaagacuaguggcgugaaacacauuuuuuccu

SEQ ID NO: 2253917 - RNA, 84 nt, Homo sapiens
ugugaauccuguagagcucuaucauugguuaauuaaucaugguguucauggaacugauauugauggaaaacuacugcguucaua

SEQ ID NO: 2253918 - RNA, 73 nt, Homo sapiens
gcuugaaccugggaggcggagguugcagugagccgagaucgugccauugcacuccagccuaggcagcaagagc

SEQ ID NO: 2253919 - RNA, 75 nt, Homo sapiens
cuccuucuuaccagcgcguuuucaguuucauagggaagccuuuccaugaaacuggagcgccuggaggagaagggg

SEQ ID NO: 2253920 - RNA, 67 nt, Homo sapiens
guacauagucacacauauacauacaugugaaaauacucauuuaagguuuguguguguuuaccugugc

SEQ ID NO: 2253921 - RNA, 67 nt, Homo sapiens
gagcaacacuguuuauuggauagcccuaaagaacccuuuacuuggcaucuagggaacauguauguuu

SEQ ID NO: 2253922 - RNA, 60 nt, Homo sapiens
ugaguucaugcuuguaguucuagacuuaucccauguugaggaauagccuccuugaacuca

SEQ ID NO: 2253923 - RNA, 73 nt, Homo sapiens
ggauucgguuugccaguguuucauugagaauuuucacaucgauguucaucagggauauuggccugaaauuucc

SEQ ID NO: 2253924 - RNA, 78 nt, Homo sapiens
gugcacacguagaagcaugcaucacaaacaagaagucuuagaagccaccuguucgugugugugugugugugugugugu

SEQ ID NO: 2253925 - RNA, 78 nt, Homo sapiens
acacuuuggaaauguguuugcauucagugagucuuuugcacuacauuggagaaacugcaaacauacuuucuguugugu

SEQ ID NO: 2253926 - RNA, 59 nt, Homo sapiens
gcaugcuuccucacuaagcuuagccauuucuagcuugugauuuagagugagagacaugc

SEQ ID NO: 2253927 - RNA, 129 nt, Homo sapiens
uaaagaauaaugaguucauaccuuuugaggcuuugugauugauuaaugugugcuaacuuggccaaguuccugguauguauucaauaaauggaaagugacgaaauguuuagaaugauggcaaguuuuuua

SEQ ID NO: 2253928 - RNA, 61 nt, Homo sapiens
ugcuuguugauguuugaauuggccaacugacuuucucuggccaguguaaugauagcaggca

SEQ ID NO: 2253929 - RNA, 87 nt, Homo sapiens
ucuuauaccucaaauccaacaucccuuccuagcacuuggugugggggaccccaggccaagugcugggacaggugugcagguacaagg

SEQ ID NO: 2253930 - RNA, 84 nt, Homo sapiens
gucuguuucugcuuuggggcggccguggugaguacccagcaaauaaauguaccaccacucccgcauucuaaaaccagggcagac

SEQ ID NO: 2253931 - RNA, 55 nt, Homo sapiens
gauauugaaucccuacacugaucucaguagaaaucucagguagggcuucaacauu

SEQ ID NO: 2253932 - RNA, 123 nt, Homo sapiens
gaagcaugguacucagacauuuuaagggagggcauuuucugggucaucagggguuaaaggguugccagucuugacagcugaggcccagaguaccccccaccucuggacuucuaggcaggcuuu

SEQ ID NO: 2253933 - RNA, 79 nt, Homo sapiens
uugaccaaguaaagacugagaauagaucuugaagaauauggugaaaaucuucauaguucuuuuagucauuauuugucaa

SEQ ID NO: 2253934 - RNA, 70 nt, Homo sapiens
gagacagggucuugcucugucgcccaggcuguguaguggcgcgaucucggcucagugcaagcucugccuc

SEQ ID NO: 2253935 - RNA, 55 nt, Homo sapiens
guggaaugcaguguugauucaacacucaauguugaaaucaaucaguguaauuuac

SEQ ID NO: 2253936 - RNA, 62 nt, Homo sapiens
caucacaucugcaugguaaguagcaguuguucuggaugguucuugcuaucaugauguagaug

SEQ ID NO: 2253937 - RNA, 66 nt, Homo sapiens
uaaacauuuuggauuaugucuucuugauugauugaaugcuuugucauugugacaugaucuuguuua

SEQ ID NO: 2253938 - RNA, 106 nt, Homo sapiens
uuuaccugauuacguugucugauguuaacagcacuacguggggauccaggauuucacuuggauaccaugcagcaugcuuuagagucagagagguggaacuggugaa

SEQ ID NO: 2253939 - RNA, 76 nt, Homo sapiens
caucuugcauaucauguuaugaggcucuagauguuauuuaaucauuuuaucuggcuccuuuugacaaugcuccaug

SEQ ID NO: 2253940 - RNA, 84 nt, Homo sapiens
aaugcaauucauuuauaaaucuaaaucucauaugggcacauaccuggugugugugggugcagaucuggagagggaaugagcauu

SEQ ID NO: 2253941 - RNA, 73 nt, Homo sapiens
uuggcaaaugucacaaaucaggacuuuuccccaccuacccacugcuaagagcugguuauuaaacauuugccaa

SEQ ID NO: 2253942 - RNA, 68 nt, Homo sapiens
ucauaauaggaauuccauagcuugcaauuuauuucgugaauaucaagugacuggaguuccauuuuuga

SEQ ID NO: 2253943 - RNA, 120 nt, Homo sapiens
aacaacaaugauaauauaggaacgaaaacagaacuuguagauuugcccaaauuaacucuguuucuccaaauuugagguguauggcaaguugaacguuuguucucucugcaauuguuaguu

SEQ ID NO: 2253944 - RNA, 64 nt, Homo sapiens
uauaugaagccaggauuuauuauugcugucuacauacuaggcaauauaaagugugcuucaugug

SEQ ID NO: 2253945 - RNA, 92 nt, Homo sapiens
ggguuuuggagugauggagaccuuggaacaaaucuuggcucuaacacuagaguuuugagaucuuggccaaguuucuuagcuccuacaaaccc

SEQ ID NO: 2253946 - RNA, 84 nt, Homo sapiens
ccuggaggauccuaaccacucuaguccccaugcauccaacaaacaguaacugagcacugaauacuguggugguggcccucuagg

SEQ ID NO: 2253947 - RNA, 56 nt, Homo sapiens
gguccugucacuuguggcaccagggccaguuuuuugugugcuugagugaugggauu

SEQ ID NO: 2253948 - RNA, 95 nt, Homo sapiens
gauguugagaauuuuuucauaagcuuuuggacauuuggauuuucucauuugugaaguuucuguucaaauuguuugugaaguuccugcuugacauu

SEQ ID NO: 2253949 - RNA, 113 nt, Homo sapiens
cuucagaaccaaggacauguaaaauugaaucaaguaaucugaguaagagucacugaguugacugagacuagauacugugagcaacaaaacuuauacucuuuccagaucugaag

SEQ ID NO: 2253950 - RNA, 57 nt, Homo sapiens
acaguggugucugaguggccagggaagguagcccuccccagcucucagcaccacugu

SEQ ID NO: 2253951 - RNA, 67 nt, Homo sapiens
gaccuuguagaaucucaugauuaucuguauugcaaaugaccuucucaugggauaucuuacugagguu

SEQ ID NO: 2253952 - RNA, 130 nt, Homo sapiens
acuccugaccucaggugauccacccgccucagccuccuaaagugcugggauuggccgggcaugguggcucaugccuguaaucucagcacuuugggaggccgaggugggcagaucaccugaggucgguagu

SEQ ID NO: 2253953 - RNA, 71 nt, Homo sapiens
cuuggagaaccccuacaaggcacugugucagaggaccauccccaauacacguagucaugagauucuccaag

SEQ ID NO: 2253954 - RNA, 78 nt, Homo sapiens
uuaaaauucagauucuugagcuccugcccucuaaauucaggagggaugggcuagagagcucagggauaugcauuuuaa

SEQ ID NO: 2253955 - RNA, 66 nt, Homo sapiens
gacgugcauggugggcacaugaagauagucuccuccacugcaucucauggcucacccugcauaguu

SEQ ID NO: 2253956 - RNA, 55 nt, Homo sapiens
uagagcucaucuucuuuaaacuucucaugauaguucugaggaaauugagauucug

SEQ ID NO: 2253957 - RNA, 65 nt, Homo sapiens
gugaaauguguagaggaucuggauugugaaugccugaauuaauaccccagcccugccacuuucau

SEQ ID NO: 2253958 - RNA, 87 nt, Homo sapiens
ucaggauaaggucucuugcaaaugcaguacaauccaaaaaaguugucauuguacuuauugccagaauuuaccuuugcuuuguccuga

SEQ ID NO: 2253959 - RNA, 72 nt, Homo sapiens
cugcuuggcccugggagauagaggcugcagugagccaugauugcgccacugcacucuucuucugggcagcag

SEQ ID NO: 2253960 - RNA, 61 nt, Homo sapiens
cuaaacugucuugcaguuacaugugcauguguauauguuuaugugaguaagagaguuuuag

SEQ ID NO: 2253961 - RNA, 81 nt, Homo sapiens
gacccauuugaggaggcagucuguccguucucagaucucaaaauccaugcugggagaaccacuacucucuucaaagcuguc

SEQ ID NO: 2253962 - RNA, 81 nt, Homo sapiens
gauugcaauaauacuagugaauagcaggaucuuuuuuauucaagggagaaaaauuuggcugacucacuaauuguuucaguu

SEQ ID NO: 2253963 - RNA, 80 nt, Homo sapiens
gcagggcuuaauaccuaggugauggguugauaggugcagcaaaccaccauagcacacguauaccuauguaccaaaccugc

SEQ ID NO: 2253964 - RNA, 58 nt, Homo sapiens
uggagauccuucauuuugguguuauaaugaaacugauucuagaaugacaugauuucua

SEQ ID NO: 2253965 - RNA, 57 nt, Homo sapiens
gucuggcuuauuucacuuagcauaauguccuuuuuauguugucacaaauggccggau

SEQ ID NO: 2253966 - RNA, 58 nt, Homo sapiens
uaucagauuccacauuuuaucagacucacuuaucuuugccagucugaggggugugaua

SEQ ID NO: 2253967 - RNA, 100 nt, Homo sapiens
gaggcaggagaaucgcuugaacccaagaggcagagguugcggugagccaagguggugccauugcacugcauucugggcaacaagagcgaaauuccguuuc

SEQ ID NO: 2253968 - RNA, 76 nt, Homo sapiens
gguggcaaugaggugggcggcuuggaagacuugaauuuaccaugaccucuaucagaacugccuccuccaagccacc

SEQ ID NO: 2253969 - RNA, 98 nt, Homo sapiens
gcagugagagcuguggccucuggagucacagugaccugagucagaguccagcuuugcuacugucuaucugugcuucucuagguggcagauuuaacugc

SEQ ID NO: 2253970 - RNA, 126 nt, Homo sapiens
uaaaguuuauuguuuuuggaaauaguuuuuuggcaaauauuuuguuuuguaaguuuuacauuucuaaaguugaauaaaauuaaauguuuagcaggugcuuguuguaauagaagcuauaauauuuua

SEQ ID NO: 2253971 - RNA, 59 nt, Homo sapiens
gaggcaguaguaauugaaauaagguagaccaauacugguauaugacuuacuauugccuc

SEQ ID NO: 2253972 - RNA, 74 nt, Homo sapiens
accaauagcugucaguuuuaacuagggaauaucagucuauugauguuuauagauggcugaaggcaguauauggu

SEQ ID NO: 2253973 - RNA, 83 nt, Homo sapiens
uuuugguaaugauacauaagacauuuaaaaauugauaauauauaguguuggcaauugcuaugauuugaaugugucucccaaaa

SEQ ID NO: 2253974 - RNA, 60 nt, Homo sapiens
gagaggagguggcuaugacagcuaaaugucaucuuuuacuaucauggccauccucuucuc

SEQ ID NO: 2253975 - RNA, 64 nt, Homo sapiens
ucuguguaaaacaauuagaggauuuuuuaaaaucuuaaaagucuucacuguguauuacaauaga

SEQ ID NO: 2253976 - RNA, 67 nt, Homo sapiens
ccagcagcagugcccuggauggaaagccacgucccugucacccucucacauccagggcagugccugg

SEQ ID NO: 2253977 - RNA, 66 nt, Homo sapiens
ugucauugguucuguuuaugugaugaauuauguuuauugauuugcauauguugaaccagccuugca

SEQ ID NO: 2253978 - RNA, 62 nt, Homo sapiens
ucauagucuaagguucuuuugcauaugagaaaauacagucucuaagagaaucauagacuuga

SEQ ID NO: 2253979 - RNA, 101 nt, Homo sapiens
agcuauaugugcauaccgccaugcauguauacagcuauacaugcauacaacugugcaugaauacagcuaugcgugcauaccaccacggugugugcacagcu

SEQ ID NO: 2253980 - RNA, 59 nt, Homo sapiens
auaaagccaugagcuugagaugguguacuugaaaggaccguuucaagaucagguuuuau

SEQ ID NO: 2253981 - RNA, 69 nt, Homo sapiens
augaaacuauuccuuuaugcaugugccacaaaauauuuuucuggcuuuagcaugugggaagcauuucau

SEQ ID NO: 2253982 - RNA, 83 nt, Homo sapiens
uguagcuuuguaguauguuuugaaaccaagaaguuugagugguccaaguuacauucuucuuuaucaagauuauuuuggcuaca

SEQ ID NO: 2253983 - RNA, 79 nt, Homo sapiens
uuuuaauguaacugcaguaggacucauggggaugggauuauagcauaagccuugugaguucaauuguauuuuauuaaaa

SEQ ID NO: 2253984 - RNA, 88 nt, Homo sapiens
guaguguccauucucucggccuggccguuaugcucucccugccagggucuggucauggaggaugaauggccaagggcguugacacugc

SEQ ID NO: 2253985 - RNA, 62 nt, Homo sapiens
ucagauuugucugugguugucaggcauguuaaugacauacagccauuccagccaaauacugg

SEQ ID NO: 2253986 - RNA, 61 nt, Homo sapiens
ugcugaugaaguauuuguucuggagacacaucccuuugauuccagaauuauguuaucugca

SEQ ID NO: 2253987 - RNA, 55 nt, Homo sapiens
gguccucagaggucuuuacaucuagaucuucuuccgguaacagucucucaggauc

SEQ ID NO: 2253988 - RNA, 73 nt, Homo sapiens
cuggauuuugguugccucuaugagccuguccccagggaaacacagagccacuagaggcggaucaggaucacag

SEQ ID NO: 2253989 - RNA, 77 nt, Homo sapiens
gguggggguguugggggcauuaguagucugccuuauuuccuuguucaguguuacacuugcuugcaauagccuccacc

SEQ ID NO: 2253990 - RNA, 57 nt, Homo sapiens
caaaugacuacuuuuuggaauuauuuuuccccccuggaaaguucccaguggcauuug

SEQ ID NO: 2253991 - RNA, 72 nt, Homo sapiens
uauuagguuguugcaaaaguaauugugguuuuacuuuugcaccaaccugauuacuuuugcaccaaccuaaua

SEQ ID NO: 2253992 - RNA, 97 nt, Homo sapiens
uuuugcgauggagucucgcucuguugccuaggcuggagugcaguguggcaaucuaagcucacugccugggcaacaagagugaaauuccaucucaaaa

SEQ ID NO: 2253993 - RNA, 98 nt, Homo sapiens
gaggcaggagacuugcuugaacccaggaggcggagguugcagugagcugagauugagccacugcacuccagccucgugacagagcaagacuccgucuc

SEQ ID NO: 2253994 - RNA, 86 nt, Homo sapiens
acaguuuuuuuucccuucagcagugcauaggugccauuccuuugucuucuggcuugcuuuguuguugaugggaaaucuaugauugu

SEQ ID NO: 2253995 - RNA, 74 nt, Homo sapiens
ccaacgagaucauugugggccaagcuguugugauaaaucacgcaaucuagcauggauauauugaucugcauugg

SEQ ID NO: 2253996 - RNA, 56 nt, Homo sapiens
uaugccuuuugguucaagcaacauauauggcaauguuucuugagccaaaaggcaua

SEQ ID NO: 2253997 - RNA, 55 nt, Homo sapiens
agcauggcauuccuguaaagauucuuaugaggagaguccauuugcugccauugcu

SEQ ID NO: 2253998 - RNA, 65 nt, Homo sapiens
ucuuaaacuccgugguguuggcuguaucugcagagcccuggccagcuagcauucauaguuugagg

SEQ ID NO: 2253999 - RNA, 93 nt, Homo sapiens
ucagacuucagaccgccuccaaaaaaaggauuuugauauccucuaagacuaucagaucccaauuucuggccuucaaggcuuugucuagucuga

SEQ ID NO: 2254000 - RNA, 57 nt, Homo sapiens
gccaugaggggcugugaacaguggacuccggcccagauacugcacuuuccucauggu

SEQ ID NO: 2254001 - RNA, 98 nt, Homo sapiens
caggguuugcuugguaggcacuguguuuguaggaguacagucuuaacugcuguaacaaaggggcuccaaaguacagugacuuaccaagagagaaguug

SEQ ID NO: 2254002 - RNA, 61 nt, Homo sapiens
cccagcuuguuucucuaccucacugugguugaggugguaucuaagaugcacguugucuggg

SEQ ID NO: 2254003 - RNA, 109 nt, Homo sapiens
cuauauccuaauacagaacacaguauaugacaaugcuuucuucuaaauugaauuucagcuucaagugauauagaaguauuucaugucugugguguuuguguggguguag

SEQ ID NO: 2254004 - RNA, 72 nt, Homo sapiens
guguccaaauugaaucaucugguuuccauauuaaauuuccacauauuuugccagauuuucaauacagggcau

SEQ ID NO: 2254005 - RNA, 100 nt, Homo sapiens
caaggcugcuuuguuucuuuguauguguagcccccgacagggauggggcaguguuucuucugucuagagggcacaugaugcuggaaucauggcaguuuug

SEQ ID NO: 2254006 - RNA, 57 nt, Homo sapiens
gucagaauaaaaggucauugaaugaaacaauguuguucagggaccugcuguacugau

SEQ ID NO: 2254007 - RNA, 75 nt, Homo sapiens
ugacuguauagugucuauacauauaguguauagucaugauacauacaguguauguauaguacauauguauaguua

SEQ ID NO: 2254008 - RNA, 79 nt, Homo sapiens
cuguaagugcucaaaugguccagcuagugguggaaauauuccaccugagguuuuuauuauuugacaguacuucuuacag

SEQ ID NO: 2254009 - RNA, 56 nt, Homo sapiens
uugaaagucauggcacaggcaaacggggucagcccuugucugucucguacauucaa

SEQ ID NO: 2254010 - RNA, 57 nt, Homo sapiens
gauuagcacuucaguuacaguagcacaugcucaauauucaauuguggcuggcuaguc

SEQ ID NO: 2254011 - RNA, 67 nt, Homo sapiens
aggcuugauuucaucuuuagaggaaggagaacugaagcuucugaguccaguaaaggugaagaggucu

SEQ ID NO: 2254012 - RNA, 59 nt, Homo sapiens
cagacuuccuaagaauuggccauuggaagaguucccuguggcuaaagauuuggaaucug

SEQ ID NO: 2254013 - RNA, 89 nt, Homo sapiens
cuguaggaauaauguucacuauuuaaaugauggugaugauauaauuuaucacacugcaucuguuggaauucugcacaauguugcuacag

SEQ ID NO: 2254014 - RNA, 55 nt, Homo sapiens
caguggccugacgacuggucacuggcugagccgucaccaccuuccaggaccacug

SEQ ID NO: 2254015 - RNA, 95 nt, Homo sapiens
cugagcugggacuugagauccuuuugcucaucagagauuuuccgcagacaccuggagcgcuggagcaaagaggagcucagcagugccuggcucgg

SEQ ID NO: 2254016 - RNA, 63 nt, Homo sapiens
cuauguguccauguguucucaucauuuagcucccacuuauaagugagaacaugugguauuugg

SEQ ID NO: 2254017 - RNA, 82 nt, Homo sapiens
cagucauucuuucuguggaggggcugacagaggccagaaagaauacccuagugagcucucuccacauguaaagaaaccacug

SEQ ID NO: 2254018 - RNA, 129 nt, Homo sapiens
agggucaggcaagcaagguaccuaguguacacaauuuaaggaggcacucacucucagguucacgugcagccuggagagugagggccuccuuaaauuuuacacccccuggucuuucucuugccuaguccu

SEQ ID NO: 2254019 - RNA, 79 nt, Homo sapiens
ggagggugcuaacguggucaccugaauuaugcaugucuauuguguucaaauaucauaaaucggugcaugaauacccucc

SEQ ID NO: 2254020 - RNA, 60 nt, Homo sapiens
gaugcuaugucuucucucacagagaaaacuauuuauuccggagaggagaacauggacauu

SEQ ID NO: 2254021 - RNA, 75 nt, Homo sapiens
uugggcaguaggagcagguucuuuucucucggaucuaccaagcagaauugacucuguuuuuucucuuuucuccaa

SEQ ID NO: 2254022 - RNA, 76 nt, Homo sapiens
ggcgagugggauugugggauuagcgcugccaugaaagggcuugagggagccuguuagucccgcuugccuguccgcc

SEQ ID NO: 2254023 - RNA, 77 nt, Homo sapiens
uauucaauuugauggcauguaauuauucaaaguggucucuuaagauccuuuguaguuuugugcuaccaguuguaaug

SEQ ID NO: 2254024 - RNA, 60 nt, Homo sapiens
gcaucucucccgggcuuugugguuuccuccgcugguaucacaaagcuggagggagacugc

SEQ ID NO: 2254025 - RNA, 59 nt, Homo sapiens
uccccaaauuguguuucaaggggcucugcugcuccacaguuugacagcacaugugggga

SEQ ID NO: 2254026 - RNA, 87 nt, Homo sapiens
uaguuaucacauaaauaaacaagcaauuugcucagaaauaaaugugucauuguaaacaaauugcuugucuguaguggacuuuggcug

SEQ ID NO: 2254027 - RNA, 66 nt, Homo sapiens
uagccuccagggaucacuaaggcagaagcgauuuguguguuuguacuugguguucuggaaagguug

SEQ ID NO: 2254028 - RNA, 60 nt, Homo sapiens
augugaggcuuucuagugauauuuggucccaagacuuuuaucacugucaggcccucauau

SEQ ID NO: 2254029 - RNA, 74 nt, Homo sapiens
uuuuguuacugcagcaaagccuaccccauccugacugguauguaggaugggguaggcuugcuguaguaacaaaa

SEQ ID NO: 2254030 - RNA, 63 nt, Homo sapiens
ggcaucuggaucuguccaaccggaggcaugaaucaucccuuuguccaacggauccacgcuguc

SEQ ID NO: 2254031 - RNA, 81 nt, Homo sapiens
uuuuucaggguuuguuuaucuauugacuugaugagggaggguuauacguacaaccaguuaaaagauggaaauuuugagaga

SEQ ID NO: 2254032 - RNA, 71 nt, Homo sapiens
auuuaauccucugccguagcuacucuucuccccauuuuaccgaugaggacacugagguacgaggguuaaau

SEQ ID NO: 2254033 - RNA, 57 nt, Homo sapiens
gugggguagcaggcuccuaucuacuucuucacagccacuaggaauugccuaccccac

SEQ ID NO: 2254034 - RNA, 79 nt, Homo sapiens
uuuauaaugaaaagagguuuaacugacucacagcuccacauggcugaggaggccucacaaaaccuacaaucauggugaa

SEQ ID NO: 2254035 - RNA, 77 nt, Homo sapiens
uggggcauguauugaggcauguaccaauggucugcagcaugcugggccacuuacacacaugccucaguuauuccuca

SEQ ID NO: 2254036 - RNA, 56 nt, Homo sapiens
cccucccacacggacucuaggcuggcccagugucaccaguagaaugugugggaggg

SEQ ID NO: 2254037 - RNA, 76 nt, Homo sapiens
uaacugaguugaaaguguucacaaugguauuuacauuucaaaaacuauuuguaugagcauuuuaccagcuuuauug

SEQ ID NO: 2254038 - RNA, 108 nt, Homo sapiens
cuucaaaauuucuacaauguuaaaucugccauauccuuaauuugaguaaacuggucuuugcaacuaauaaaauagcccuggauuuugugcucaaagugguauuuggag

SEQ ID NO: 2254039 - RNA, 77 nt, Homo sapiens
aacacauaacuuguuuuggccaaugaaacguaugcagaagugccaugugucaaaucuaggccaaagcuuuaaguguu

SEQ ID NO: 2254040 - RNA, 71 nt, Homo sapiens
guauauggaaaaauguaucuugucauggcucaaaagacacaacauuguuaagaugucaauuuuccacauau

SEQ ID NO: 2254041 - RNA, 76 nt, Homo sapiens
ucagccucccuaaaguagccaggacugcaggcgugcaccaccacacccuggagucucguuauguugcccaggcugg

SEQ ID NO: 2254042 - RNA, 80 nt, Homo sapiens
ucagguuuuauguucaguacuuaugggcauguuuuuauguuuccccaaaauaugucuggaguuacugagcugaagccuga

SEQ ID NO: 2254043 - RNA, 77 nt, Homo sapiens
ggagaacucaauuuggaauugucaguaaaugauggcucacuguuauauacuugcuuccaguccaagucuguuucuuc

SEQ ID NO: 2254044 - RNA, 64 nt, Homo sapiens
caguguucucucuuugaguuccuccuggugucuguuacaacagaugaggaauucaagaacacug

SEQ ID NO: 2254045 - RNA, 76 nt, Homo sapiens
cugcacucuccuauaaucacuagcauuuuuaucauucuccucacauagaccaagugcucuugugggaagagagcag

SEQ ID NO: 2254046 - RNA, 58 nt, Homo sapiens
gaggcugauugauauccauggagaauauaauuuuguucaccugguuauuaauagccuc

SEQ ID NO: 2254047 - RNA, 73 nt, Homo sapiens
uuuugccauuucccaguaaacucuaucccuccuccaccugaggacugggaugagaguguguugggcagcagag

SEQ ID NO: 2254048 - RNA, 70 nt, Homo sapiens
ucuggacaaccaagaacagagggaaagaggcagagcacucuuuggagaaaaguucuugggcuuguccaga

SEQ ID NO: 2254049 - RNA, 58 nt, Homo sapiens
uugauggccuauggcuaagcauucagucucuauuaaugcucauuagcaggccaauuga

SEQ ID NO: 2254050 - RNA, 73 nt, Homo sapiens
ggucacaccagcuccggggaacgucacucgacaggugagguuggugccgugguccuggggccaugggaugauc

SEQ ID NO: 2254051 - RNA, 87 nt, Homo sapiens
cucugguguuguggguggggauggcggaaggagugaugcaugauacguucauggcuauuucgucaugcuccccugcuuucaucagag

SEQ ID NO: 2254052 - RNA, 60 nt, Homo sapiens
gagaaugaugauuuccaauuucauccaugucccuacaaaggacaugaacucaucguucuu

SEQ ID NO: 2254053 - RNA, 97 nt, Homo sapiens
cuuaggacuuggggagugugugggacccagugugagcaacuucucuagagcaaugccaucgcauggucuccaggcagcuccccaugcuagucuuagg

SEQ ID NO: 2254054 - RNA, 71 nt, Homo sapiens
uggccaccacaucaacacagauggaugcagcagaugguuuaggaagcuccagaguggugaugcuggggcca

SEQ ID NO: 2254055 - RNA, 70 nt, Homo sapiens
guuuuaugcacaucagcuccagggaccuucugagaaucaagggugaccugacaugaaugugcucaaaagc

SEQ ID NO: 2254056 - RNA, 109 nt, Homo sapiens
ggcagaggggcugggggaguugggggaaacaugagacuggguuuguagggccccuaaggaggagcucaggacccgguccagguggguacgaguccuagguuccuuugcc

SEQ ID NO: 2254057 - RNA, 64 nt, Homo sapiens
aacagugcaaugacccgucacugacagauuuugaaagaacugcugugauuggucacugguuguu

SEQ ID NO: 2254058 - RNA, 67 nt, Homo sapiens
uucucuacgugucaaggagaagcuaaaggaagcaauugcuauuaccuuuuuaagacagguuagagga

SEQ ID NO: 2254059 - RNA, 79 nt, Homo sapiens
acggggucacuuugagaaacugcacacgaugugccugaugcacgguaggugcucaguacgugggcaguuccuuccccgu

SEQ ID NO: 2254060 - RNA, 78 nt, Homo sapiens
ucacugcauuacucaugagcauguaccuugugggaaacacaugaaucuauugugcucaugaacgaguaaugucaguga

SEQ ID NO: 2254061 - RNA, 80 nt, Homo sapiens
cuucuuagggugagucaaucugagggguucagcacuguccucaagucuuagccccguaucaguuugagcuccccuggaag

SEQ ID NO: 2254062 - RNA, 86 nt, Homo sapiens
gaauuucauuugugggaggugcuaauguaaaugguuacaaucaauuuuuguauauuuaucuugcauccugcuaccuugaugaauuc

SEQ ID NO: 2254063 - RNA, 62 nt, Homo sapiens
auuuuugguugucagcacuaggggcagguauuacuggaagcuauuggguugacaccaaggau

SEQ ID NO: 2254064 - RNA, 88 nt, Homo sapiens
ggagaaucgcuugaacccgggagguggagguugcagugagcugagaccacaccauugcacuccagcucgggugacagagugagacucc

SEQ ID NO: 2254065 - RNA, 63 nt, Homo sapiens
gaagaaagagaugugccaaauagccuuauggugccagggcuagaauccgcgucucuugacuuc

SEQ ID NO: 2254066 - RNA, 78 nt, Homo sapiens
cgggaagaagaaggugaccuguguccuguaggaguccucaccaucauuucucacagucacugucacguugaacucccg

SEQ ID NO: 2254067 - RNA, 60 nt, Homo sapiens
ccagggggucuuuuaaacaacuggggcugcguggccccaguguguaaaggccuugccugg

SEQ ID NO: 2254068 - RNA, 57 nt, Homo sapiens
gcuggaggcaucuuggaguacagggauauuucauucugagcacugagauccucuagc

SEQ ID NO: 2254069 - RNA, 67 nt, Homo sapiens
ggagacgcagugcauguggcacucuccagguggccacccucagccacucacaugcauauucguuucu

SEQ ID NO: 2254070 - RNA, 99 nt, Homo sapiens
gaggcaggagaaucacuugaacuugggaggcagagguugcagugagcugaaaucaugccauugcacuccagccuggccgagaaagcaagacuccgucuc

SEQ ID NO: 2254071 - RNA, 67 nt, Homo sapiens
ccugaggaaauuguaaugacuucacuugaggcagcugccuuggaagacaaugcugauucucuucagg

SEQ ID NO: 2254072 - RNA, 75 nt, Homo sapiens
guguuuuuugucuuugguucucuuuauaugcuggauugcaucuauugauuugcguauguugaaccagacuugcau

SEQ ID NO: 2254073 - RNA, 61 nt, Homo sapiens
caguaccucaguuggaaaugcagaaaaccuuugucuucugugucauucaugcugggagcug

SEQ ID NO: 2254074 - RNA, 57 nt, Homo sapiens
ugagaugaagucuugcucuguugccagucuggagugcaguggcaugauaucagcuca

SEQ ID NO: 2254075 - RNA, 60 nt, Homo sapiens
acaaaaauucaugucugccagaaucucagaaugugacuuauuuggcaauaggguuuuugu

SEQ ID NO: 2254076 - RNA, 66 nt, Homo sapiens
gaacagugccugucauuuaguagacauucacaaaauguuuguugacugaauauacagcuauugggc

SEQ ID NO: 2254077 - RNA, 55 nt, Homo sapiens
uugagauggagucucacucugccgcccaggcucgagugcaguggcacuaucuuag

SEQ ID NO: 2254078 - RNA, 65 nt, Homo sapiens
acauggugaaaccucaucucuacuaaaaauacaaaaauuagccgggcaugauggugcacacaugu

SEQ ID NO: 2254079 - RNA, 68 nt, Homo sapiens
gagaggaaagccauucagcucucagggucaacaaguugguugacccugaagccaugaguggaacucuc

SEQ ID NO: 2254080 - RNA, 82 nt, Homo sapiens
ggagaagaguuguggaaguguaaaagcucuuggacauuaauauugugggccaaaaguuaggcauucaccauggaaucucucc

SEQ ID NO: 2254081 - RNA, 78 nt, Homo sapiens
uaaauggugugcuuaggucauuuacauuuuagguaauuacuuauauguuuguacuuaggccuauuauuucaucauuug

SEQ ID NO: 2254082 - RNA, 61 nt, Homo sapiens
guuuucgugucuggucugugaugggaggauaauauauucauuuacuuucagauaugaaggc

SEQ ID NO: 2254083 - RNA, 80 nt, Homo sapiens
ucagauauuugggcaaguggcaugaccauggauuauuucacugguuuucuuccucguagcccuugcucuccagcuauuga

SEQ ID NO: 2254084 - RNA, 64 nt, Homo sapiens
ggagugccuauugauggaaagauaccagauauuuuuauuaaguaucuauacauuaauguauucc

SEQ ID NO: 2254085 - RNA, 75 nt, Homo sapiens
gcauauuguugugguuuuaauauucagucuagauaucuuuuccuuuuauuuagaguauuuuaagccauuauaugu

SEQ ID NO: 2254086 - RNA, 67 nt, Homo sapiens
uaauaacuaugugaggugcugaauauguuaauuacuuugauugacauaaucauuucacaguguauua

SEQ ID NO: 2254087 - RNA, 130 nt, Homo sapiens
cucccacaacacaugggaauugugggagcaacaagucaagaugagauuuggguggggacauagccaagccgugucaccacccaaaucucaucuugaauuguacucccauaauucccacauguugugggag

SEQ ID NO: 2254088 - RNA, 56 nt, Homo sapiens
cuaagauggagucuugcucugucaccccuggcuggagugcaauggcaccaucuugg

SEQ ID NO: 2254089 - RNA, 93 nt, Homo sapiens
uugucaucaucuagcagaacaauacaauucgguugccggggcuuuuccuuccuguccugaguugaauugugucucucccaaaagauaugauga

SEQ ID NO: 2254090 - RNA, 58 nt, Homo sapiens
ccugugaugaagaguccaagaacagccugagauaaggaugucauucuucuuucacagg

SEQ ID NO: 2254091 - RNA, 129 nt, Homo sapiens
guauacucccuuacugcguggccuuggacaugucacuuccucucugauggccucagucucuucucagucuccucugagguaaucagagaggaagugacauauccaaggccacacaguaaggaaguauac

SEQ ID NO: 2254092 - RNA, 74 nt, Homo sapiens
ggugcuuucaccagcuggcauugaauaccugugucuuuuccaggugcauggugcaagcuguugguggaucuacc

SEQ ID NO: 2254093 - RNA, 58 nt, Homo sapiens
uuggaugauaaagaagccuaagaugagacaucuucccugagguugcuuucucauuuag

SEQ ID NO: 2254094 - RNA, 99 nt, Homo sapiens
gaggcaggaucuugcccuguugcccaggcuggagugcagugucacaaccauagcucacugcauucuugaacuccuggguaacagugauccucccgccuc

SEQ ID NO: 2254095 - RNA, 62 nt, Homo sapiens
ggccccuggcagucugccucuucacuguagcuggcugcaaguguagagaagaguugcuggcc

SEQ ID NO: 2254096 - RNA, 59 nt, Homo sapiens
gauaagggaauaaaagcaggcugcuugagccagcagcagcucauuuggguccccuuguc

SEQ ID NO: 2254097 - RNA, 73 nt, Homo sapiens
caacagucaccgagugugccaucuucucacagaccucuaguagcaggauuucacauuuuggaaaacacuguug

SEQ ID NO: 2254098 - RNA, 56 nt, Homo sapiens
uaaaaaauauugaucgaagggaacaguggcuguuuccuuuggucaguauucuuuug

SEQ ID NO: 2254099 - RNA, 59 nt, Homo sapiens
ugaucucaggugauucacccacuuuggccucccaaagugcugggaucacacugaaauca

SEQ ID NO: 2254100 - RNA, 94 nt, Homo sapiens
ggcgccugcaucugucugguuucuccugaggauuucaugcuaucucauaacaugcuggaaggucaaagggaaagcagacaaagccaaaggagcc

SEQ ID NO: 2254101 - RNA, 66 nt, Homo sapiens
uccuccaccacugcccucaguuugaagcaaucaacacaucaaacuggcauauucugguugcgggga

SEQ ID NO: 2254102 - RNA, 81 nt, Homo sapiens
ggguccugcuguugcucaggcuggagugcaguguugugaucauggcucacugcagccuugagcucucagaucaaggugccc

SEQ ID NO: 2254103 - RNA, 98 nt, Homo sapiens
cagaaagcaugcuguugauucugaauuguuugugcucuguuuuuggucuuagauuuagcacgaaaccaaauucugugauucaaagcaacaugucacug

SEQ ID NO: 2254104 - RNA, 120 nt, Homo sapiens
guaacaucugugucaucucagcaaucguaucuguugauuguuuuucuuguucaaguugagaccuuccugguucuuggcaugaagaauaauuuuugguugaaaggugaacaucuugguuau

SEQ ID NO: 2254105 - RNA, 86 nt, Homo sapiens
ggaguuucccucuuguugccuaggcuggauugcagugacaugaucucggcucacugcaacuccgccucccagguucaagcaauucc

SEQ ID NO: 2254106 - RNA, 64 nt, Homo sapiens
uugucagauggauagauagcagacauuuaaucccauuccguagguugucucuucacucugauga

SEQ ID NO: 2254107 - RNA, 76 nt, Homo sapiens
uuggcaccagagagcauguuccugacuaugacaccauggccaccucacaccaggcaacgugcauuucuggugucaa

SEQ ID NO: 2254108 - RNA, 56 nt, Homo sapiens
cccaggcuggaaugcaguggcacgaucucggcuuacugcauccuccgccucuaggg

SEQ ID NO: 2254109 - RNA, 69 nt, Homo sapiens
aguucacccucuaauaacucuacgaggcaaaugcuauuguccauauuuugcaguuacagagagugagcu

SEQ ID NO: 2254110 - RNA, 64 nt, Homo sapiens
ucuaucccagauaauguucugugugcacuugagaaaaauuuguaggcuguuguuuugggaugga

SEQ ID NO: 2254111 - RNA, 78 nt, Homo sapiens
gggaagagauuuggaaauggaugguggugacaguugcacaacagugcaaauguuaguaacaccacugaauugugucuc

SEQ ID NO: 2254112 - RNA, 101 nt, Homo sapiens
ugaggcaggagaaucgcuugaacccaggaggcagacauugcagugagcugagauugcaccauugcacuccagccugggugacagagugagacuccgucuca

SEQ ID NO: 2254113 - RNA, 83 nt, Homo sapiens
gcuggugaggagaaagauaaaaggaugauagggaacaguacucaguucuugcagagucaguuauuuugccuauuucuaccagc

SEQ ID NO: 2254114 - RNA, 58 nt, Homo sapiens
cucagcuucuaccuccugagugaaaccucuucaucuuccucaccagguguaggcugag

SEQ ID NO: 2254115 - RNA, 112 nt, Homo sapiens
uaauaaaauauucauggucaaacuguucuugucuugauuagauaacaggaauaugaaaaugugcaucuguuuaguuaagacauagaauuuuuugcagauaaaugauuuauua

SEQ ID NO: 2254116 - RNA, 88 nt, Homo sapiens
caaugagaacauauacuugaaagcacuuaguaaauuagaaaugugggucacaaauaauacugcugugcuugaguuguuguuguuguug

SEQ ID NO: 2254117 - RNA, 84 nt, Homo sapiens
gugucucagcuuggaauaucuuguaucugaccucauaaaauugauccugauuuugugggugguaaaauacaaugauagaggugc

SEQ ID NO: 2254118 - RNA, 113 nt, Homo sapiens
uccuaauugugucaggaagaaagaagagcuacggagugguacaagguaccugcuuuaacuucagaaacagguacuuucccaaccauacugggcucccacugucuacucaagga

SEQ ID NO: 2254119 - RNA, 100 nt, Homo sapiens
uacagucacauucugagguacugggggccaggauuucaccguauaauuuugggggaacaaaauucagccuauaauaguccucagagaaaagaccaaugua

SEQ ID NO: 2254120 - RNA, 59 nt, Homo sapiens
gauuggcauucuggccugguucaugccaccucuauguugacuacaccaggaugcuaguu

SEQ ID NO: 2254121 - RNA, 76 nt, Homo sapiens
uugcauucuugcugacacuuaauuuugucaaaauuuuaauuugaguuuuuuggugguuaugugucaaugacuguag

SEQ ID NO: 2254122 - RNA, 83 nt, Homo sapiens
cccuccguggccuuuguuucauagggugugagaggaugaacaacgucuucucaauggguuguagacaaagugugauaagaggg

SEQ ID NO: 2254123 - RNA, 75 nt, Homo sapiens
cuggcuauuuggaaugaaacagcagagccccaaagagaaaaauuuugaaagggcuccauguucauuuaauaccgg

SEQ ID NO: 2254124 - RNA, 67 nt, Homo sapiens
aaucccagugugaacuuggcauuuucuaauuauuucauaaaugagaauaucaaaucacauugcgguu

SEQ ID NO: 2254125 - RNA, 87 nt, Homo sapiens
ucccuggagauguacgagagcauuaagccaucaucauucacccaugauacauuuaccuauggucuugaucggcucucccaucuugga

SEQ ID NO: 2254126 - RNA, 80 nt, Homo sapiens
aagcauuuuuaucuugcuuauguugaauuguucaagagaccaaaggaauuuggcaaagaucaacauguuaggaugugcuu

SEQ ID NO: 2254127 - RNA, 60 nt, Homo sapiens
uguuaauugaaugcagacaccagggagaagcaauuuccuggacaugugcauuaagagaca

SEQ ID NO: 2254128 - RNA, 100 nt, Homo sapiens
gcucuucuuuugaaucucccagugacccaggaacaggcugaugugaagcacaacccggacuucauccugugccagguguucugggaauugagaggagggu

SEQ ID NO: 2254129 - RNA, 105 nt, Homo sapiens
uuggaacuaaaaaagaacuuuggaaaugaucuguuucaauugucuuaguuaaacuuguggaaacuaaaguugaagaaggucaaauuauuuguuuuaauuguccaa

SEQ ID NO: 2254130 - RNA, 130 nt, Homo sapiens
cuaacucaggacuuguccuuauggugguggcagggauucaacgagagagcaggagugcacacagcuauuagagucuuagguuuaaucacuucuaccacauuccaugggccaaagaaaaucacuaagauag

SEQ ID NO: 2254131 - RNA, 96 nt, Homo sapiens
gacaggagaaucacuugaacccaggaggcggagguugcagugagccgagaucgcaucauugcacuccagccuuggcaacaagagugaaacuccguc

SEQ ID NO: 2254132 - RNA, 81 nt, Homo sapiens
ucuugaucucccuuuccuauaugaugauuugcuuaaauauccauauuaaguaagucucaagguaggguaggcagccugaga

SEQ ID NO: 2254133 - RNA, 57 nt, Homo sapiens
gugucaguggggagugaucuucugauuuuaagguuuuaaguuguuucucacuugcac

SEQ ID NO: 2254134 - RNA, 61 nt, Homo sapiens
cugagaucaugggucaggugguuuguacucuagcaauaaaagcacuugacuuguuucucag

SEQ ID NO: 2254135 - RNA, 130 nt, Homo sapiens
auggaaggaaagcuuucuuauuauaggcccaagaucauuuaugcuaaaauuucuggauguuaagagaaguuuguucauuaaaaugaacuuuaaaugggugugacauguggaggagacaguuucacuuccu

SEQ ID NO: 2254136 - RNA, 69 nt, Homo sapiens
ugcaugugggcagaacucggggaaggaaaaggcacugacuuggauugcacugagauuuugcuuacagca

SEQ ID NO: 2254137 - RNA, 70 nt, Homo sapiens
gccauguacauaguagacacugaaaauauauauauauauauauuuauucagugucuaguaucugccuggu

SEQ ID NO: 2254138 - RNA, 108 nt, Homo sapiens
cagaguugauuccagaauggaauauguguaaagaguucacauuuguuguaucuuaguugguauuccacaauaugauuuuuaauagaucuuucauuuugaucucaucug

SEQ ID NO: 2254139 - RNA, 63 nt, Homo sapiens
cuauguguccauguguucucaucuuuuagcccccacuuauaagugagaacaugugguauuugg

SEQ ID NO: 2254140 - RNA, 61 nt, Homo sapiens
guguaaccauauauuucagaguuaucucacucagagggugagggagcuggaauauuuauac

SEQ ID NO: 2254141 - RNA, 81 nt, Homo sapiens
cagagaucuaauuuaccauuuacuuuuuaaugacaaugguaaguuuuucugucauguaaagaguaaauggugacuuuucug

SEQ ID NO: 2254142 - RNA, 60 nt, Homo sapiens
auuucugcuggcagguguguuauaaagguguuuggucuucuuggcaaugucagcagagau

SEQ ID NO: 2254143 - RNA, 78 nt, Homo sapiens
ugaaaauuacuaauggagcagguuuuacauguucuccacaaaaaguaugugagguaauuagcucccuuagccauuuca

SEQ ID NO: 2254144 - RNA, 62 nt, Homo sapiens
uggccaguguuuuuccugggcuggcauagccuuggucagcuagagcugagaagcacuugcca

SEQ ID NO: 2254145 - RNA, 100 nt, Homo sapiens
caaaacacagagaguggcugauugggcauggaguggccuuauguuuugaaauaauuacacguggagccuucucuggcuuucagaauuucuucugguuuug

SEQ ID NO: 2254146 - RNA, 90 nt, Homo sapiens
gccacaccuacguauuugcauauugucucugguugcuuuuguaccacugcagcagaggugaguacuugcaacagagacuguauguguggc

SEQ ID NO: 2254147 - RNA, 129 nt, Homo sapiens
ugcauugguuuuguuuuucauuuauuagguuggugcaagagugacugcaguuuuugccaugaagagcagugacaaaaaccgcaguuacuuuugcacuaaccuaauaaaaagucauacaguuuuauugca

SEQ ID NO: 2254148 - RNA, 81 nt, Homo sapiens
gccccugauggaaugguguggcaaguuauaaucugcuaucaacacaaugcacaucacuguccacucaucuuucucuggggu

SEQ ID NO: 2254149 - RNA, 57 nt, Homo sapiens
cuuuugggauccaagggggucuuagucuuagaaccaguccccuguggauaccgaggg

SEQ ID NO: 2254150 - RNA, 70 nt, Homo sapiens
aaaaugaugaugguguuuugauaggaauugcauugaaucuguagauugcuuugaacaguauggucauuuu

SEQ ID NO: 2254151 - RNA, 71 nt, Homo sapiens
gcaugguacuggaugguaguaugccauagauucaaccuccccuaauuuuccugcuuuuuccaguaucaugc

SEQ ID NO: 2254152 - RNA, 85 nt, Homo sapiens
gcuaacugguuauuuugcaugccaguugauggaguuucuucauaguguugauggccuuuacaauuugguauguuuuuucaguggc

SEQ ID NO: 2254153 - RNA, 112 nt, Homo sapiens
guccuuuguuuuucuuuccuuuuacaauggcuagaaccuguauauucauugcugaguggaaguggugaaagcacgcauucuugccuuguaagaacagggaccuuaggaggac

SEQ ID NO: 2254154 - RNA, 62 nt, Homo sapiens
uucucagccucgauuucguuucuacuuuucaacaugggaggaaauguuuaagggguugggag

SEQ ID NO: 2254155 - RNA, 82 nt, Homo sapiens
gccauuuucacuucuucugugauucuucaguuacuucaggccaucuggauguauacgugcaggucacaggggauaugauggc

SEQ ID NO: 2254156 - RNA, 80 nt, Homo sapiens
ggggagcuugguuauucaugcacccaucuuaugacaagaagaccaugcaugguaguaaccuacauuugagagcuuacccc

SEQ ID NO: 2254157 - RNA, 73 nt, Homo sapiens
gcaaauuauuggcaaaugugagaugagaacuuauagcuccugugauucuagucuggcauagccacaaacaugc

SEQ ID NO: 2254158 - RNA, 89 nt, Homo sapiens
aaguugauucuugcauuucuucuacuugguggauuuaauauuugcaaaucaccagugucagggaacugcuuacuuuggaggaaucacuu

SEQ ID NO: 2254159 - RNA, 129 nt, Homo sapiens
cucgcuuuuucaacguugugcuccaagcagccauugucaguuaugguuuuucugugagauggaacccauuuuucaucccguauuagaccauauggcuaugagaauuuacagauaggagaaaccagugag

SEQ ID NO: 2254160 - RNA, 61 nt, Homo sapiens
cuacugucaauagucaauguguaacaucuuacaauucaggcagcauugguuagaacaguag

SEQ ID NO: 2254161 - RNA, 73 nt, Homo sapiens
ucaaaugauucagaagccaccugcagugaaaugacugucagaaaugcagcugguucugaaaacuuuauucuga

SEQ ID NO: 2254162 - RNA, 76 nt, Homo sapiens
auggaagucuccauagucuucgaagaaugaguuagacucagauaacauuagccuaaguaacuguggagacagccau

SEQ ID NO: 2254163 - RNA, 115 nt, Homo sapiens
acuaccuaagaucucugcuaguaaauggcugaaugaucuggacuacaauucuuuggacucuuccuucucaggagauccuguagucucacagccccauagcugugaucuagguagu

SEQ ID NO: 2254164 - RNA, 88 nt, Homo sapiens
aagaaacagccuuguuuuuguuguugaaauuccuaugcauuauauugcauggcuuguuaugcauuaguaccuaagguuuaaguuucuu

SEQ ID NO: 2254165 - RNA, 96 nt, Homo sapiens
uuuauuguagugaauauguuagaguguagcaggaagaggcaauauauucaauacuggucuuuuccuuuauuauuucacuuauauuuaagcaaugga

SEQ ID NO: 2254166 - RNA, 64 nt, Homo sapiens
ugagaucaaggugggcccugggggccgcccccgccaugcccugcagugcucaccuugggucuca

SEQ ID NO: 2254167 - RNA, 61 nt, Homo sapiens
gguguugggaaaacuggcuagucauaugcagaaaauauaaacuggaccccuuccauacacc

SEQ ID NO: 2254168 - RNA, 70 nt, Homo sapiens
guguaugcaugucucuguacacgugugcacauguacacauguaugugugcgugugcagggaugcaugugu

SEQ ID NO: 2254169 - RNA, 92 nt, Homo sapiens
uaucuacaucacugaaaacuuacaaagcuauagcaccagagggaacuccugaggucucucgcuauagguuuugcaauucauaauuggagaua

SEQ ID NO: 2254170 - RNA, 62 nt, Homo sapiens
auaugucuggcagaagacuucucaguggaaaccucauaugcugagagaguggcaugacauau

SEQ ID NO: 2254171 - RNA, 106 nt, Homo sapiens
gcauacacauugccucugaagaccuuccagugggacgagauguggagguggaagacagugacauucaugaucgugacccuggguaggccuaggcuaauguguaugu

SEQ ID NO: 2254172 - RNA, 87 nt, Homo sapiens
gggcccccagggucuuggucaggagccucccucuuucgcuugugcaaggaagggcucuccucacccagccgacccucagggaggccc

SEQ ID NO: 2254173 - RNA, 59 nt, Homo sapiens
ugagacugagucuugcucuuguugcccaggcuggaguacaauggcacgaucucggcuca

SEQ ID NO: 2254174 - RNA, 65 nt, Homo sapiens
ggaagcauugaggggcaugcauugaggaucucccccacucacccuauggcuuagucaguguuucc

SEQ ID NO: 2254175 - RNA, 89 nt, Homo sapiens
ccugggguuucgugaggaaaacagaggguguuuuuuccuccaaaauggggucuguggcaccuccucuguuuuucccaaggagucccagg

SEQ ID NO: 2254176 - RNA, 66 nt, Homo sapiens
uaggaguaugugcugugaaaugaucuaaaauuuguaauauuuuugucaugaacuguacuacuccua

SEQ ID NO: 2254177 - RNA, 100 nt, Homo sapiens
uacaguauuuggggaguuaagguacuggaaagaggaauggguugaugguugagaauucgauccuuacaucugagugcugauaagauccuaacccacugua

SEQ ID NO: 2254178 - RNA, 73 nt, Homo sapiens
cuuugaggguaucaccccguagagucugcagcuacuuccugggguggcugcuccucuguggaggugcucaagg

SEQ ID NO: 2254179 - RNA, 62 nt, Homo sapiens
gucugaugucucugggauuagcuucaaaauaaaauggugagguugggaugagggauacagau

SEQ ID NO: 2254180 - RNA, 62 nt, Homo sapiens
guuaagggaagccuggguaagacuauaaucacauuauuugcuuaucuuucuuccucauuagc

SEQ ID NO: 2254181 - RNA, 56 nt, Homo sapiens
cccaggaguuggaggcugcagugagguaugaucaugcuacugcacuccaccuuggg

SEQ ID NO: 2254182 - RNA, 90 nt, Homo sapiens
gggaacuuguuaaagauucagauucuuaggccucacccuagagcuaacaaaucagaguaucugggagacuacauuuuuaacaagcuuccc

SEQ ID NO: 2254183 - RNA, 85 nt, Homo sapiens
gugcuuauaaaaauuguuauuucuauaugugaaugagguuuuuuaaauaggagaucaauucauggcauaguuacauuaugugcac

SEQ ID NO: 2254184 - RNA, 88 nt, Homo sapiens
ggagaaucgcuugaacccaggauggggagguugcagugagcugagacacgcuauugcacuccagccugggcaacaagggcgaaacucc

SEQ ID NO: 2254185 - RNA, 59 nt, Homo sapiens
ucagaugaugucccuguucuaacccuaacuagcugugcgaccuuggaggacaucacuga

SEQ ID NO: 2254186 - RNA, 56 nt, Homo sapiens
uuuagcagcaaagagccaugcucuguaaaagagauaguggcucucagcuugcuaag

SEQ ID NO: 2254187 - RNA, 87 nt, Homo sapiens
uuggcaagaucaauguaaguggauuucaaauuccauaaggaacugauuugguggagaacauucauuugcaagaguagauuuagcuaa

SEQ ID NO: 2254188 - RNA, 58 nt, Homo sapiens
ggggcgucaccggggcaccugggaccgggcuuucugcuguaggacccugguggccccc

SEQ ID NO: 2254189 - RNA, 58 nt, Homo sapiens
uaguggcuacugacugaugauuauaauuuuaaauuguaaauauggcuaguggcuauug

SEQ ID NO: 2254190 - RNA, 112 nt, Homo sapiens
agucucgcucuuugcccaggcuggagugcaauggcuugaucucggcucacugcaacccucugcuuccuggguucaagcaauucuccucucagccucccaaguagcugggacu

SEQ ID NO: 2254191 - RNA, 92 nt, Homo sapiens
cagccugcuuuuugaaguuuugaaguguggcacugaguuuuccucucuaacuaugaaagucuuagauggcaucuucuuucaauauaaggcug

SEQ ID NO: 2254192 - RNA, 76 nt, Homo sapiens
gcaccuagaacaaugccuggcacauaguagacacccaauaaauacuuacugacaugaucaggcauguucagggugu

SEQ ID NO: 2254193 - RNA, 55 nt, Homo sapiens
uuggccauaaauaucauauuuccaauugaaaaauggaagaugauguuugggcuaa

SEQ ID NO: 2254194 - RNA, 56 nt, Homo sapiens
uccuuucucccagguuaguugucaaccugcuggagcucaacccugcagagaaagga

SEQ ID NO: 2254195 - RNA, 59 nt, Homo sapiens
cugggguaggacuggcuuuugacaauggauuuauccauauggaguuguuucugccccag

SEQ ID NO: 2254196 - RNA, 60 nt, Homo sapiens
ccaacaguacaugauaaauaagguauugucugagaccuugcuuuauauuuauguaguugg

SEQ ID NO: 2254197 - RNA, 55 nt, Homo sapiens
uaagugaauauggacaguuagcauuuagcaacauguaucugucuacuuucucuug

SEQ ID NO: 2254198 - RNA, 59 nt, Homo sapiens
ggauaccaucacugauuauucagggcccaagggcucuuuaguaagcaguugaugaaucc

SEQ ID NO: 2254199 - RNA, 60 nt, Homo sapiens
gggaaaugugggagagccaguggacauucagugaguaguaaacagcucugccacaauccc

SEQ ID NO: 2254200 - RNA, 60 nt, Homo sapiens
guggguaaaucucuguuugaggcucucagcucugaaggcuugagaccccugauuucccac

SEQ ID NO: 2254201 - RNA, 57 nt, Homo sapiens
ccuggaucauugucauucccaaucaucucccucuugaggaguagacccugaaccagg

SEQ ID NO: 2254202 - RNA, 100 nt, Homo sapiens
cacuggcuggaugccuucacaggcacugguucagaugccagagcacuggauucauccuuaggggggcucugagccagacugggugaggguggcccaggug

SEQ ID NO: 2254203 - RNA, 77 nt, Homo sapiens
ccagaaucaggaucuuauuuggggaaaggguccuugcugauguaguuaaggauccugagaugaagagaucauucugg

SEQ ID NO: 2254204 - RNA, 57 nt, Homo sapiens
uugacuguaagauggcuauuacaauuuuaaggugacaauaugcucucucacagucaa

SEQ ID NO: 2254205 - RNA, 56 nt, Homo sapiens
guaaaauagaauaacguggcuauccuuaaagaugucacguugcuuuucuguuguac

SEQ ID NO: 2254206 - RNA, 73 nt, Homo sapiens
cuguggguuuuacuguuuuacugucaucauuuuacaccaaucacugagagguaaagccugauaagacuuacag

SEQ ID NO: 2254207 - RNA, 64 nt, Homo sapiens
auugugaguagugcugcaguaaacauaugugugcaugugucuuuauagcagcaugauuuauaau

SEQ ID NO: 2254208 - RNA, 84 nt, Homo sapiens
ggaucucgcucuguugcccaggcuguagugcaguggugcagucacagcucacugcauccuccauauccugggcucaagcgaucc

SEQ ID NO: 2254209 - RNA, 75 nt, Homo sapiens
gccuggauguccuggacccagacaaagcucgaccauuuucugcuguguaugguguucaggacagaugguccaggc

SEQ ID NO: 2254210 - RNA, 57 nt, Homo sapiens
ggguuucugcagagggauccacuguuacucugaugggcuucccuuuguagaugaccc

SEQ ID NO: 2254211 - RNA, 56 nt, Homo sapiens
ccauuuugagguguuugugcaccaucugugacacacacagcaaacacuguaaaugg

SEQ ID NO: 2254212 - RNA, 55 nt, Homo sapiens
caggaguucucucauuuauagauuauuacagcucugugagguagaggguuaccug

SEQ ID NO: 2254213 - RNA, 60 nt, Homo sapiens
gauuccuuuuaaugguuaaaguugcaggucugaaaauauuuugaucauuaaaagugaauc

SEQ ID NO: 2254214 - RNA, 80 nt, Homo sapiens
ucagauguccuagagagaugguggucuggauggaguccaucuaggaaagauucccugaccaucacccucaucugcacuga

SEQ ID NO: 2254215 - RNA, 56 nt, Homo sapiens
guauugacuaucaaucaugugcccaaugcuguggaagcaugauagacauuuaauau

SEQ ID NO: 2254216 - RNA, 66 nt, Homo sapiens
uguuguugguucuguuuagaugcuggauuacauuuauugauuugcauauguugaaccagccuugca

SEQ ID NO: 2254217 - RNA, 57 nt, Homo sapiens
gaaggucuuugaguuaguccugaaaaaggcacgguucagguacacugacaugccuuc

SEQ ID NO: 2254218 - RNA, 77 nt, Homo sapiens
gucauguucugagaagugcgucguuugaugaugaugucgauaugccaacaugagauggcacuuccacgagccuagac

SEQ ID NO: 2254219 - RNA, 74 nt, Homo sapiens
uucuggccuaagguacagaauucugucccuugaguggacacugggaagagagaauucugucacuauccccagag

SEQ ID NO: 2254220 - RNA, 62 nt, Homo sapiens
gaguucuagacucugucccuaggaagaaauaaagauccucccuaggaccaguucuguaauuc

SEQ ID NO: 2254221 - RNA, 79 nt, Homo sapiens
cuuuucaauuaucuuuguaugaccuacuacacuaaaggcaucuugaagcuauguaugguuuauagggaaauuguagaag

SEQ ID NO: 2254222 - RNA, 75 nt, Homo sapiens
gaagguuuuccuacaugcaguacauucaaaggguuucucuccauuuuuaauucucugauguagacuaaggccuuu

SEQ ID NO: 2254223 - RNA, 60 nt, Homo sapiens
gcaaucacuuugcucuccaguguggggauaucaccacaggugcagagcugaagugaaugu

SEQ ID NO: 2254224 - RNA, 84 nt, Homo sapiens
cagacaucugacugagguauaucccauuagaaguuccuuuaguaaaggucuauugaugaaguguucucauucuuucuuugucug

SEQ ID NO: 2254225 - RNA, 86 nt, Homo sapiens
guggaugauccucugugcuugcuucuucuccuaguccguguauggcgugacugaagagucccaggcacagagcccggugcauguac

SEQ ID NO: 2254226 - RNA, 69 nt, Homo sapiens
agaugaugauggcgcuuuaucuucuucagucuucccacgaugucugugaaguaggugcuguuauuaucu

SEQ ID NO: 2254227 - RNA, 65 nt, Homo sapiens
cucuggauguaaaugaaacuacagucacaggugugggucuguuuuagcuuucuuuauauucagag

SEQ ID NO: 2254228 - RNA, 63 nt, Homo sapiens
auugagccuaggaggcagaaguugcagugagcugagauugcaccacugcacuccaggcuggau

SEQ ID NO: 2254229 - RNA, 97 nt, Homo sapiens
uggugguugaagacucccgagcugaguguuccaagagcgagccaggcugaaacuguguucccuuuuaugacuuagccuuggaagucuggcaucauca

SEQ ID NO: 2254230 - RNA, 64 nt, Homo sapiens
uggaaaaugcagcacucaagugggaacacagaaaugcauuuucucacuuugggcuguaguucca

SEQ ID NO: 2254231 - RNA, 61 nt, Homo sapiens
guugacuaggagcuacuacuacauuagaaacgagagucucagaagccuuaucuuagucaau

SEQ ID NO: 2254232 - RNA, 67 nt, Homo sapiens
aggcgggguggaucauuugaggucaggaguucaaaaccagcuuggcuaucauggugaaacccugucu

SEQ ID NO: 2254233 - RNA, 66 nt, Homo sapiens
uaaggguguaaucuauauuucugacauuacaggucaaagauauauaguaaguauagagagcccuua

SEQ ID NO: 2254234 - RNA, 98 nt, Homo sapiens
ggcaggagaaucgcuugaacccgggaggaagaaguugcggugagccgagauagugccaucgcacuccagccugggcaauaaaagcgaaacuccauguc

SEQ ID NO: 2254235 - RNA, 82 nt, Homo sapiens
aucaguugaaaguuuuuaauugcagaacuaaggcuucucugcagaagaagaaauuuaucuguaguuaacagcuucagcuggu

SEQ ID NO: 2254236 - RNA, 89 nt, Homo sapiens
aggcagucacaggauaauaaagcugaauccuuccugaaugucucuaaaauguucaugguucuuucuagcuuuaugguuggucacugccu

SEQ ID NO: 2254237 - RNA, 79 nt, Homo sapiens
gugcggauggauugcuaauguggggauuuggggggaaaucaaaguguucucaaaugcuguauuguaguaauacuugcac

SEQ ID NO: 2254238 - RNA, 56 nt, Homo sapiens
ccugagcccaggaaugcacuucagcuccugguugagcaaugucacugaggcuuggg

SEQ ID NO: 2254239 - RNA, 60 nt, Homo sapiens
aguagauuccagugauaguuaaauaagaagugauuucuucuaaugaccacugauucuacu

SEQ ID NO: 2254240 - RNA, 65 nt, Homo sapiens
ggccugaguggagggauucugcagcaguucaugagaccugcugacauggggauccaccuuaggcc

SEQ ID NO: 2254241 - RNA, 71 nt, Homo sapiens
gauucuaaaagcuaguguuccagugaacaggcagaaguugcaugaccuuuuaugaccuagcuuugcaaguc

SEQ ID NO: 2254242 - RNA, 67 nt, Homo sapiens
gaauagaauguauauucuguaguuguuggguagaauguucuauaaguauccauauauacauuuguuc

SEQ ID NO: 2254243 - RNA, 78 nt, Homo sapiens
uucucugacccuguaaauguccugcuacagagugcauacgaaaggauguacuuaggugagauauuuucuugcagagaa

SEQ ID NO: 2254244 - RNA, 90 nt, Homo sapiens
uguggcuuaaauuuagauucaguauggaauacauuuccagagagagaguggaguaaagauauaugacugagacuuaaauugugggugaua

SEQ ID NO: 2254245 - RNA, 60 nt, Homo sapiens
uuuuauccagccucuagcaaggucuucacacauugcaaggauuuagcuggcuggguagaa

SEQ ID NO: 2254246 - RNA, 58 nt, Homo sapiens
uuuaacauuggaugagaucgucuaagugaacuaguccagugucccauccgauguugaa

SEQ ID NO: 2254247 - RNA, 71 nt, Homo sapiens
ggugagcauguuuaggcuuuauuacagggucucagaugaagguuugaccuguaauaagucacaugucugcc

SEQ ID NO: 2254248 - RNA, 56 nt, Homo sapiens
uaucuguucuuuaaaacuuugauagacgucuaugaaauuguuugcaaggauaggug

SEQ ID NO: 2254249 - RNA, 71 nt, Homo sapiens
aggcaugagccacugugccuggccugaauuuuuaaaugacacauuuaagccaggugugguggcacaugccu

SEQ ID NO: 2254250 - RNA, 67 nt, Homo sapiens
uuccaaggugcuauauuucgaggauagugugcucugaccaccauucguggaaucuagcgcacugggg

SEQ ID NO: 2254251 - RNA, 83 nt, Homo sapiens
uuaaagaaaaccuuguauagguggcaaaacugaaauuuaaaguacugcaauuguuucaguagcauugcuuauacagucuuuaa

SEQ ID NO: 2254252 - RNA, 57 nt, Homo sapiens
uugcuagucucuguuucaggauaggguauuaacuaucugggcagcagcagcuaguag

SEQ ID NO: 2254253 - RNA, 100 nt, Homo sapiens
gaggcaggagaaucuuuugaacccaggaggcggagguugcagugagcugagaucaugccauugcacuccagccuagguaacaagagcgaaacuccgccuc

SEQ ID NO: 2254254 - RNA, 59 nt, Homo sapiens
uacuacucugcagagaugcauaacaguaaaacacguguagcauguuugucagagaagug

SEQ ID NO: 2254255 - RNA, 66 nt, Homo sapiens
agccaguggaucuuagcuggcugggcuccguugggggugggauccacugagcuagaccacuuggcu

SEQ ID NO: 2254256 - RNA, 100 nt, Homo sapiens
auggugaauuuugaauuuauaacuaaugagcuugaauauuuuuucaauacaccauuggaagacuuuagaggcuuauaauguagggaauaagauucuccau

SEQ ID NO: 2254257 - RNA, 69 nt, Homo sapiens
augucuucuuuauuuuuaguauauucuuacuuagaaguuuggagaauguaaacagaauagaggagauau

SEQ ID NO: 2254258 - RNA, 58 nt, Homo sapiens
gucauugcuuaucugcugacguucuuccuuggcauaaagcagcagcugggcuugugac

SEQ ID NO: 2254259 - RNA, 57 nt, Homo sapiens
auguguggaaguguguugcccccgugugcaaauaucuaucauagcacuucagcacau

SEQ ID NO: 2254260 - RNA, 58 nt, Homo sapiens
ggaaacugagauucaaagagguucagugucauaucuggccaagauaaucucaguuuuc

SEQ ID NO: 2254261 - RNA, 124 nt, Homo sapiens
cugaucuuguuggacgugucuugccagagucuucuuucccuuugaaacuaaacuugcucuauuuuuagaaagcacagaauagcagagagaacacagggucuggggcaggcaacucuaagauugg

SEQ ID NO: 2254262 - RNA, 66 nt, Homo sapiens
cuuaacagugguauugaugaccauuaauccuucaaccuaaaccugcucauuaaugcugccuuuaag

SEQ ID NO: 2254263 - RNA, 59 nt, Homo sapiens
cugguuaugcuagcagugaaguugucacagggacagacucaggaccucuaguuagccag

SEQ ID NO: 2254264 - RNA, 130 nt, Homo sapiens
ucaucaugaguuuguuuuuagcuuugauucccugaaagcugagauuggaauucuugugcaugugugcucucugcggaaacuucuaaccuuacuagggaaucaagacaaggaggggaacaagaucagaugg

SEQ ID NO: 2254265 - RNA, 93 nt, Homo sapiens
gugauggcucuauucaccagccuuagucuuuaguucuuaaaaacuaauguucuuagugcugagauugagaagcccugggucagaguaauacac

SEQ ID NO: 2254266 - RNA, 58 nt, Homo sapiens
uugcccuuugcauggccugcugugggauucccucgcagcacgagcaugcaaggugcag

SEQ ID NO: 2254267 - RNA, 59 nt, Homo sapiens
uucuuuccauugcuuuuuggacuaaaauucucuaagcccagaauucucauuggaaggaa

SEQ ID NO: 2254268 - RNA, 70 nt, Homo sapiens
gucucugaauaaaagauuucauacaccaauaccagauauauacauugauggaauuuacuuauuuaggggc

SEQ ID NO: 2254269 - RNA, 76 nt, Homo sapiens
agaacugcaguaaacuuucccauucaaagagcagagaaauaggaggcagauugcaaugauaguuuauagcaguucu

SEQ ID NO: 2254270 - RNA, 105 nt, Homo sapiens
uauuacuuguaauguuaucugugauuauauaguuaagguagugucugccauuuuuuucacuguaaaguuacuguuuuucccuuuguaauauacuaauaaguaaua

SEQ ID NO: 2254271 - RNA, 65 nt, Homo sapiens
aucagaaucucuugagaguguuccaagugucuucauuuuaaacaaucuuucuagaauauuuuggu

SEQ ID NO: 2254272 - RNA, 75 nt, Homo sapiens
uuuauuuaaaacauauuuauuaagugccuacuauguuucaacuauuguguuaggcacugagaauaugaggaugaa

SEQ ID NO: 2254273 - RNA, 89 nt, Homo sapiens
agagcucacaacucauuuguggguagcaagauuugaaaccaagacgugauucaaaucuuuggcucccacuaguuaugucauggagcuuu

SEQ ID NO: 2254274 - RNA, 89 nt, Homo sapiens
ggagaaucgcuugaacccaagagguggagguuauggugagcugagaucgugccauugcauuccagucugggcaacaagagugaaacucc

SEQ ID NO: 2254275 - RNA, 56 nt, Homo sapiens
cugacuuaugcaacucugaugugcagucguugcaccagagcucucugcaagguuag

SEQ ID NO: 2254276 - RNA, 80 nt, Homo sapiens
ggaggaagggaggaaagauguaauauuaucuaaauaucguagcaacauuuggagauagauacauuuuucuccauuuuucu

SEQ ID NO: 2254277 - RNA, 57 nt, Homo sapiens
aaguucuaucucuagacacagccagaaaggccuggcuagugcagugggguaugacuu

SEQ ID NO: 2254278 - RNA, 91 nt, Homo sapiens
aucaaagagaccuaggcuuaaaguauaguuccucugguuacuaaguauggaauaaucagaaguagacuguauaguguuuuccagguuugau

SEQ ID NO: 2254279 - RNA, 113 nt, Homo sapiens
uuuuuauaaguuuggcaaauuauuaccaacacugauaugaaguuagcuggcuguguuucagugaauauaauuuuugggaacuuuauauuaugguauuuugauacauauaaaga

SEQ ID NO: 2254280 - RNA, 55 nt, Homo sapiens
gaaggccauugcguccugggauucuauuuuuugaccugauguucacuuggccuuc

SEQ ID NO: 2254281 - RNA, 64 nt, Homo sapiens
gacuaggagagcagcugcccauggcucgaagccuuccaacucgugggcaguggcccaccugguc

SEQ ID NO: 2254282 - RNA, 63 nt, Homo sapiens
caauguuaggugcauauauauguaggauaguuaagucuucuugcugaauugugcccuucauug

SEQ ID NO: 2254283 - RNA, 94 nt, Homo sapiens
guggcuuggcugugguuugggugagcaguguccuugggggcaagcaauuugcucccaccagguacacgugcucacuggggccccagggagccac

SEQ ID NO: 2254284 - RNA, 72 nt, Homo sapiens
ggauaugauuucaauuggauaugauuucauuguuucuuaauggaagcauaguauucuauuguguauaugucc

SEQ ID NO: 2254285 - RNA, 63 nt, Homo sapiens
gcacaguguuacuugauauauuuuaaacauuguuguuuugguuaagucagcaguaacaugugc

SEQ ID NO: 2254286 - RNA, 96 nt, Homo sapiens
cuagaaggcagucccucucaugcaagacuacuugucagaugaucaaucugucugguuggaguaguuuucagaacagaaggcucucugcuugauuag

SEQ ID NO: 2254287 - RNA, 55 nt, Homo sapiens
uuugaaacucccuuuugucuaguagacugugcccuacaguagaagggauuucaaa

SEQ ID NO: 2254288 - RNA, 125 nt, Homo sapiens
ugacuuuuauaugcacugagauaccaaaaaaauucguaugaccucgcuuuauugcagucauacgaaguauucugcaauacuucgagguaugccuguauguuggucauuucaauaugauucaguca

SEQ ID NO: 2254289 - RNA, 63 nt, Homo sapiens
cgcccgucguguguggguuuauccucauagaacuuugagcacagagacuggcccaggcgggug

SEQ ID NO: 2254290 - RNA, 63 nt, Homo sapiens
cacacugaccagacaguuauaggaauauccucagcgccauccuuauaugacuucuucagugug

SEQ ID NO: 2254291 - RNA, 63 nt, Homo sapiens
uuuauauuuaucuauuuugccuuguuucagaaauggauuuaagguaagcuagaaagauguaga

SEQ ID NO: 2254292 - RNA, 55 nt, Homo sapiens
agguggcaugaagucuuuuugacgcugaagaauguaucaaaguccuuugcuaucu

SEQ ID NO: 2254293 - RNA, 96 nt, Homo sapiens
uguauccaagauauuuccaaggagaguacauuuuuacuuuuucaggugcuaugauuaaaccucuuaacaguguauuccuuuggacagaggcauaua

SEQ ID NO: 2254294 - RNA, 68 nt, Homo sapiens
aaccuguacugcaguugcagcuugaggagaggacuccuguccuccguaucacuguaggacaccagguu

SEQ ID NO: 2254295 - RNA, 102 nt, Homo sapiens
acuguuaccuggugcacuuaaucucauucguucccucauucauucauccuauguagaauucaggggcuacuagguguuagaaugaggagacaucagaacagu

SEQ ID NO: 2254296 - RNA, 82 nt, Homo sapiens
gugcaaaaauuuguuuucaagucacuggacauaaggcaaugaaauauaaugaucccugagugauugaaaauaaaggaaguac

SEQ ID NO: 2254297 - RNA, 75 nt, Homo sapiens
uugcuugagcccagaaguugaggcugcagugagccaugaucaugccauuguacuccagccugggcagcaaagcaa

SEQ ID NO: 2254298 - RNA, 65 nt, Homo sapiens
aggauucuuguaaagucugucucagucaguuuagaacauugggacaaauucuacacucagaucuu

SEQ ID NO: 2254299 - RNA, 99 nt, Homo sapiens
gugaauaagggccaagugcaguccugucuugauuaaauuacuuaauaauauuauuaaauaauaauaggucugggcaguauuguuuuuaaccugacucau

SEQ ID NO: 2254300 - RNA, 86 nt, Homo sapiens
uaaguucuaggguacaugugcacaaugugcagguuuguuacauauguauacacgugccauguuggugugcuguacccauuaacuug

SEQ ID NO: 2254301 - RNA, 130 nt, Homo sapiens
gugguugugugugcccugagccuugagaucagccugaggucaggcuuaagaucuucucagauguuuucugagcaugcaucuugccugggccucaguguggcuuuuucaauuccccuguauauauaacugc

SEQ ID NO: 2254302 - RNA, 83 nt, Homo sapiens
guaccaaugucaauuuccugguuuugauauuguacuauaguuaugcaagauguuaccauuagggaaaacugacugaaggguac

SEQ ID NO: 2254303 - RNA, 63 nt, Homo sapiens
uaguuagauucacaaagggagcaagcaaccuacaguucuugauccucugagaaucuaucgcug

SEQ ID NO: 2254304 - RNA, 63 nt, Homo sapiens
cuuacccgacaucaaaaaguucauacuggugagaaaccuuaugaauguaaagaaugugggaag

SEQ ID NO: 2254305 - RNA, 62 nt, Homo sapiens
cuauuagguuggugcaaaagucauugcggguuuugccacuacuuuuuucaccaaccaaauag

SEQ ID NO: 2254306 - RNA, 66 nt, Homo sapiens
gguauuucuaguucuagauccuugaggaauccacacugucuuccacaaugguugaacuaauuuacu

SEQ ID NO: 2254307 - RNA, 129 nt, Homo sapiens
gcgccugcgugaagugagagaaaggggauuagaagguggugucagagagcuuaugggaaaagagaaagugggucauauaggaucugcacaccaucuuaaagaucuggcuugagacacugggcauggugc

SEQ ID NO: 2254308 - RNA, 60 nt, Homo sapiens
gugggacacaaguuugauaaaagguucugcugcacacaccccuacaggcuuguguccugc

SEQ ID NO: 2254309 - RNA, 65 nt, Homo sapiens
aagcuggcauucaugagauuacuggaaaugaucuacacacaaaggaauuugauaaaugcuagcuu

SEQ ID NO: 2254310 - RNA, 68 nt, Homo sapiens
aguccaugagaaugaagccuggcgugugaggcgggccacagauguggguguuuucauucuagagggcu

SEQ ID NO: 2254311 - RNA, 57 nt, Homo sapiens
cugagcucauuucuuuugcuaccauguacugauuacaaggcagagauggccgcucag

SEQ ID NO: 2254312 - RNA, 87 nt, Homo sapiens
ugaggauauuaauuuuguauugcuugaggaaaugguaauguccuccccugaggcaguugcccugcaagacaguacugaugcucuuca

SEQ ID NO: 2254313 - RNA, 89 nt, Homo sapiens
ccuagccaaaggaaugguguuggggcacggccucuguugcccucuuuggggucccagccugugucucaagcccacacgccgcggcuggg

SEQ ID NO: 2254314 - RNA, 69 nt, Homo sapiens
gggccgcugcaccguggaguauggggaggaccugcccgagugcguccagguguacuccaugggcggccc

SEQ ID NO: 2254315 - RNA, 88 nt, Homo sapiens
ggaacacuucugucuagauauaaaauuacuuugguucagcaaauaaaauaacuuugguucauguaauuuugugucuaugacuuguucc

SEQ ID NO: 2254316 - RNA, 80 nt, Homo sapiens
augauuaauaguuccauuuauucucgucucucgccaaaagggaugguaggagaaaaggagaaggaauuccuguuaguugu

SEQ ID NO: 2254317 - RNA, 89 nt, Homo sapiens
uguauuagguuggugugaaaguaauuaacgauuguugccauuaaaaguaaugguaaaaaauacaauuacuuuugcaccaaccuaauaca

SEQ ID NO: 2254318 - RNA, 72 nt, Homo sapiens
ucugcccuggcuuccagcuggguucagucagugaaaggcacuggcagaagacugaguugggauaggguaaga

SEQ ID NO: 2254319 - RNA, 80 nt, Homo sapiens
uuuugaaaacaaauuugucuuauugggauuaucuuugguagaaauagagaugccuaugaagagaaauuauguugaaaaaa

SEQ ID NO: 2254320 - RNA, 63 nt, Homo sapiens
aaagggcuaucacaggugacauguaaugguuuguuuuuacccauuucaauguggauguucuuu

SEQ ID NO: 2254321 - RNA, 65 nt, Homo sapiens
ucuccaaaguuuguuuucuuggggcauucuuccacauaggugcacucagaaaacagauaaggaga

SEQ ID NO: 2254322 - RNA, 95 nt, Homo sapiens
aacagugaaagugcauguaaaauauuaagaaacagaaggugcacaaauuuaucuguuguuaucauaauauugaucaauaugugcauauucauguu

SEQ ID NO: 2254323 - RNA, 78 nt, Homo sapiens
cuuccccaguaggcaauuaacaccuggguucuagccaauggguaauuuucucucuggucuuaaaauguccuggggagg

SEQ ID NO: 2254324 - RNA, 72 nt, Homo sapiens
caguauugacuccuuuaaccucauguagcuuucgugacuuugaaacaccauguaguagaaggagccagacug

SEQ ID NO: 2254325 - RNA, 55 nt, Homo sapiens
gaagcaaggauauagaauuuagggcuucuuauucccaaaauucugucccuucuuc

SEQ ID NO: 2254326 - RNA, 59 nt, Homo sapiens
ggaugacauuacagucacuugcuguuggcuuugcucacagucaagaugugugucuauuc

SEQ ID NO: 2254327 - RNA, 67 nt, Homo sapiens
aaguccccuggggacaaaguccucaucuuggugugucuuugagauggauuuuguagccccagcacuu

SEQ ID NO: 2254328 - RNA, 58 nt, Homo sapiens
ggccaccuagaggguggaugcgcuggccaggugcagcagcucaugccuuugggaggcu

SEQ ID NO: 2254329 - RNA, 74 nt, Homo sapiens
guagagaugaggucucacuauguugcccaggcuugucuccaacuccugagugcaagugauccucccaccucugc

SEQ ID NO: 2254330 - RNA, 64 nt, Homo sapiens
gaguaagugcucuugaaacugccuuagcaaaauuaugacugagacagugaaagagauuuaacuu

SEQ ID NO: 2254331 - RNA, 79 nt, Homo sapiens
uggaaucaaauugucaaugaacggaauugaauggaaucauagaacagaauccaauguaaucaucauugaauugaaccca

SEQ ID NO: 2254332 - RNA, 81 nt, Homo sapiens
guguaugugaaguaugguaucucauguuggauuugaaaugaauuuucugaaucauugguuaugaguaccuguuccaugugc

SEQ ID NO: 2254333 - RNA, 67 nt, Homo sapiens
gaauuauaagagauaaagaccacauagugcuggagcugucaguggauacugucucugucugucauuc

SEQ ID NO: 2254334 - RNA, 59 nt, Homo sapiens
guguacugauaaucguggcagggagaacaaaugcguaucuuguccauuuguugguacac

SEQ ID NO: 2254335 - RNA, 78 nt, Homo sapiens
aaucauguguauuuagcagugguugguuucugugcuuuuauaugucucaguaaagccagaccuguuaauugugugauu

SEQ ID NO: 2254336 - RNA, 95 nt, Homo sapiens
gaauuaucuuuuagauguauuguugaauauggcuugcuaguauuuuguuggggauguuagcaucaauauucaucagauauauuggccuguaguuu

SEQ ID NO: 2254337 - RNA, 105 nt, Homo sapiens
uggaugugguggugcacuccugugguuucagcugcucaggaggcugagggaggaagauggcuugagcuagggagaucgaggucgcagugagccauaaucaugcca

SEQ ID NO: 2254338 - RNA, 71 nt, Homo sapiens
ucuuuaucugaugucuugagauggagcuuagaguauugauuuucagcuucuaauagauguacauuuaagga

SEQ ID NO: 2254339 - RNA, 66 nt, Homo sapiens
uuuguuugcugcauugauaaauccccaugacuauccagguacaggauggcacuguagcaacacaaa

SEQ ID NO: 2254340 - RNA, 64 nt, Homo sapiens
uguggcucuucuguucuccacugcaggaacauugcugcucaaaaaagagagggauagagcuaca

SEQ ID NO: 2254341 - RNA, 68 nt, Homo sapiens
cccagagagguggguggagcccccaauuccugaaaaauugggggcuccacccaccucuaauguauggg

SEQ ID NO: 2254342 - RNA, 57 nt, Homo sapiens
ggugggcauuccaaugguuaaaacucucauaaguagugacuagggauaugugccacu

SEQ ID NO: 2254343 - RNA, 125 nt, Homo sapiens
ccaggacaguuguaaaguacuuuguaagauauauuuugugaaaucagauagccuuuuuaaauagccuuuagaaaagcugcucuguuucuaaaauguugugacugauuuuuacuucguaacucugg

SEQ ID NO: 2254344 - RNA, 78 nt, Homo sapiens
ggaccaacaaauguaagaaagugagagguaugggaguagagaccaguauuucccuuaacuuuccugcagcaaugguuc

SEQ ID NO: 2254345 - RNA, 64 nt, Homo sapiens
auauuuuugguuucaccugcacgccagguauauucauuuggcugagcagaacaauuagaaauau

SEQ ID NO: 2254346 - RNA, 101 nt, Homo sapiens
cuuauguguauauuaauagcauaugcaucuuugaguuauugugcagacugaaugacaucaucugcacaaaugauucacaagaaugccugcuucacaauaag

SEQ ID NO: 2254347 - RNA, 61 nt, Homo sapiens
uaaguuacuuuugcucgaucucuuguuaguuuaguucauugguugaugcugaaguugcuua

SEQ ID NO: 2254348 - RNA, 64 nt, Homo sapiens
ccuaccucuuuguaauaagaauugaggcaaauuugucaucaaaugcucuuugcagagagguagg

SEQ ID NO: 2254349 - RNA, 107 nt, Homo sapiens
gauaacuuucaacuguuaauucaaauaccuuuuaggggaacguucugaaguuuagacuuuagaaucuccccagaauagguuuuguguguuuuguucuucuuguuguu

SEQ ID NO: 2254350 - RNA, 66 nt, Homo sapiens
ccucugugcacauuguuuaugucuguuggacaauuuuccagcaauaccccauguugcacaugaagg

SEQ ID NO: 2254351 - RNA, 78 nt, Homo sapiens
ggguagcauucgugugauacugaugacuuagagaauuauuuuguaauuucuccuguaagguaugcacauugcucacuc

SEQ ID NO: 2254352 - RNA, 84 nt, Homo sapiens
cacugccuagucagggaaauuguucagaagccuggcugagaaaaagauuugaaccaucccuuucugagcaguuccuggguagug

SEQ ID NO: 2254353 - RNA, 73 nt, Homo sapiens
agggaaccuuuguacacuguuggugguuauguuaauugguacaaccauuaugaaaaauaguguggaguuuccu

SEQ ID NO: 2254354 - RNA, 61 nt, Homo sapiens
gcagccaaugggggacuuggccaagcgucaggcacugauggaagacuccucucuuggcugc

SEQ ID NO: 2254355 - RNA, 60 nt, Homo sapiens
cugcuuuuucuaggaggacaauuauauuuuugauuaauauuguaauuuuagagaaagugg

SEQ ID NO: 2254356 - RNA, 85 nt, Homo sapiens
uauuuguaaugugguuauaacagaucuuggcacauaguaaucuauauaucugucuagaucugaauguaauuguacuauacaaaug

SEQ ID NO: 2254357 - RNA, 59 nt, Homo sapiens
cagaauugggaguguccugauaucccgauaucuugagaacagaagcauuccuaauuuug

SEQ ID NO: 2254358 - RNA, 56 nt, Homo sapiens
uccaggaggcggagguugcagugaaccgagaucacacuguugcacuccagcuuggg

SEQ ID NO: 2254359 - RNA, 95 nt, Homo sapiens
guuuaagauuugagaaauuaacucuuuccaguuuggaggaugcauuuguggggaguguuccauacuagagagacgcaauuacuaugagugaagac

SEQ ID NO: 2254360 - RNA, 87 nt, Homo sapiens
ugccagaaacauuuggacuuuuauucugcaggcaacagggaggcagcggcuuuuaugcucaaaaggaaugagucccaguggcuggca

SEQ ID NO: 2254361 - RNA, 71 nt, Homo sapiens
gucuuaaagccauucuggggacuccggcuuuaacugugcaagagguggguagucauuggaggguuuugagc

SEQ ID NO: 2254362 - RNA, 77 nt, Homo sapiens
cugacuggaucauuacacauucugugcauaugaaaaaauaucacacauacugcauaaauauguguaauauguaucag

SEQ ID NO: 2254363 - RNA, 66 nt, Homo sapiens
ugaagggcauuguuuugccaaaguucguuaaguuaaaaaauauuuuggaucaauaaaugucuuuca

SEQ ID NO: 2254364 - RNA, 68 nt, Homo sapiens
gucauauucaagcugggcaaauaaggggcucuggauacuaaaggaccuuuuauuuagccagcuuuggc

SEQ ID NO: 2254365 - RNA, 113 nt, Homo sapiens
agcuuuuugaugugcugcuggauucgguuugccaguauuuuauugagcauuuuugcaccaauguucaucagggaucuuggcccaaaauucaacagcccuucaugcuaaaagcu

SEQ ID NO: 2254366 - RNA, 72 nt, Homo sapiens
uuuuauaagauuacuauaaugugcagcuuauaacugcaaaaugugagaucugucuuuauaguauuuaugaag

SEQ ID NO: 2254367 - RNA, 85 nt, Homo sapiens
uguacagugaaacuuugguuaucauacuuucagggaccaaauuaucagaguuuugaaguuaaaauaacuaauguuuuaaagugca

SEQ ID NO: 2254368 - RNA, 90 nt, Homo sapiens
ugacuugcagcagccuaugguacucucuugucugcaaauuuucugcccugauuaauuacaaagagugccagaguguguugacguuaguua

SEQ ID NO: 2254369 - RNA, 74 nt, Homo sapiens
uucuuugagcuuauuagagcauuuugcuuauuccauccauuaaguaguugaaauguauuaaugaguugaaagag

SEQ ID NO: 2254370 - RNA, 120 nt, Homo sapiens
ggcuucuaguugacagcuggaaauggaggcauuucuggcagagaaacaggucuaaggaggcagcgccagcuuccucagguccugucucuacaaggccccauugcuguaacuagccaagcc

SEQ ID NO: 2254371 - RNA, 119 nt, Homo sapiens
gcuguauuucuucuccuuugacuuagaauggaagguugagaagaacuguggccuguucaaccccaggccuucucuuagcacuuuguguuacuguguugggggccaaaaaggaaucaggc

SEQ ID NO: 2254372 - RNA, 87 nt, Homo sapiens
agccugguggcuaaaagcaagggguggcaagcugggcugccugaguuugagucccaguuuugccacuuacuagccagccauguggcu

SEQ ID NO: 2254373 - RNA, 68 nt, Homo sapiens
uugcuugaacuggggaggcggagguugcacugagccaagauugcaccacugcacuccagcuugggcaa

SEQ ID NO: 2254374 - RNA, 64 nt, Homo sapiens
agauggaauucucuguagaguuucucaguccacuuuuaacaauggaugagaacagacuccauuu

SEQ ID NO: 2254375 - RNA, 76 nt, Homo sapiens
ggguggacaugaauuuugaggagacaccauucgaacauaucuuuguaucucuuccuucucaggguguguccuaccc

SEQ ID NO: 2254376 - RNA, 69 nt, Homo sapiens
uuugaggagguagucugucccuuagcagagcuagagagcugugcuggaagauccacugcucucuucaga

SEQ ID NO: 2254377 - RNA, 68 nt, Homo sapiens
ggguacaugugcacaacgugcagguuuguuacauauguauacaugcgccauguuggugugcugcaccc

SEQ ID NO: 2254378 - RNA, 68 nt, Homo sapiens
gcuacauucucguagugcuaguuccaggaagaugccuaugugccccugauagcacuacagaguuuagc

SEQ ID NO: 2254379 - RNA, 56 nt, Homo sapiens
gaaugcauuuuuuaaaagcauauugcuauaaaaagccaugcacgugaaaugcauuu

SEQ ID NO: 2254380 - RNA, 82 nt, Homo sapiens
aguucuaggguacaugugcacaaugugcagguuuguuacauauguauacaugcgccauguuggugugcugcacccuuuaacu

SEQ ID NO: 2254381 - RNA, 127 nt, Homo sapiens
uccacaaucccuugugauucaucucuuuccuccuaaggguugccaauggcucaaaguuuagacuugggauauaaaaaacgcuauucacagccuuauuaggaggaguagguggggaaggggaacugga

SEQ ID NO: 2254382 - RNA, 129 nt, Homo sapiens
aauugacuguaaagcacuauauaaagauuaagcuuuguuaaggucauaggaagaauucaaacucgaauaucuacuugauugauauucuuucuggaucccaaaauguaaguugauauaugauguguuauu

SEQ ID NO: 2254383 - RNA, 56 nt, Homo sapiens
guuugucaucaucaucaucaucauaucacuuuuuagggcagugagagaugacaaac

SEQ ID NO: 2254384 - RNA, 79 nt, Homo sapiens
ugucaggcauuguucuagaaacuggaguuacauguugaguagaagagauaaacaccauucucuguaacaagaacugaca

SEQ ID NO: 2254385 - RNA, 64 nt, Homo sapiens
caggugcauuggcugacaccuguaauccuagcacuuuaggaggccaaggugggcgaaucaccug

SEQ ID NO: 2254386 - RNA, 108 nt, Homo sapiens
uauauguaccauauuuucuuuauccaauccacuguugauggguaccuggauugauuucaugucuuugguauugugaauaguguuuggaugaacauaugggugcaugug

SEQ ID NO: 2254387 - RNA, 103 nt, Homo sapiens
ggcucuacccaguccucuugucuugcacacgguugccacgcucacggagaaaggaugaugguaugaccguggugcaagcacaagggaugaggccaaaagagcc

SEQ ID NO: 2254388 - RNA, 70 nt, Homo sapiens
aaugcuguucauugaugacacugauuucuucaauguucauacauguugaagugugugucagaacuuuauu

SEQ ID NO: 2254389 - RNA, 58 nt, Homo sapiens
uuucaacaggucuggggugguccguggaguggaauggacugcugcagcuauguugagg

SEQ ID NO: 2254390 - RNA, 100 nt, Homo sapiens
cuggaccauuugaaguugaacauguuacuucagauuucugggcuucauuuuucuccuugaguaagaucagaguaacauugacaacuucauggaguucugg

SEQ ID NO: 2254391 - RNA, 58 nt, Homo sapiens
guauauggcauuuuguaagggcuugccacguaauaagccucuaacugaugucaaauau

SEQ ID NO: 2254392 - RNA, 89 nt, Homo sapiens
ggaguuucacucuuguugccuaggcuggagugcaguggcacgaucuuggcucacugcaaccuccgccucuuggguucaagugauucucc

SEQ ID NO: 2254393 - RNA, 59 nt, Homo sapiens
aauuuugagacaaaguuguuggauguucaucuguaugaacacugaaaugucuuaagauu

SEQ ID NO: 2254394 - RNA, 130 nt, Homo sapiens
ggugugguuuguuuuuguuucucugguuccaugaggugugaccuuagauaguuuauuugugcucuuucagacuuucugauguaggcauuuaagguuaugaccuuuccucuuaacacugccuuuccguauc

SEQ ID NO: 2254395 - RNA, 93 nt, Homo sapiens
uuguuauuuauuccggucuuucucacaucagauuugaccaacucuaccugacuugaucaaaucugagugagaauuccaaauuauggguaacaa

SEQ ID NO: 2254396 - RNA, 91 nt, Homo sapiens
cugguaguuaaagauugaccaggaccuaaucaguuauuugcauaagaaaagcacugugaagaucccuguccuguuccauucuaauuaccag

SEQ ID NO: 2254397 - RNA, 61 nt, Homo sapiens
guggcaugaaagcaucugugauuguuagugguguuauaaucacagguacagcuaaugcuac

SEQ ID NO: 2254398 - RNA, 74 nt, Homo sapiens
gaaaaugccuuucuuacuaugggucaagaucaaaaaaguuuggaacucacuggucuaaguggagggggauuuuc

SEQ ID NO: 2254399 - RNA, 55 nt, Homo sapiens
uugacugggccagacagagauccuugcuggggaucucucugguggucacagucag

SEQ ID NO: 2254400 - RNA, 70 nt, Homo sapiens
ccuauuucaugagagaccuacagcuuauuaccuugcuguguggaaugaaaacucucucacaaagaauagg

SEQ ID NO: 2254401 - RNA, 74 nt, Homo sapiens
agccuuaaguagugugcauguauguaugugcacacguguacauguaugccuguuugcgcauugagagcuaggcu

SEQ ID NO: 2254402 - RNA, 55 nt, Homo sapiens
uagugcaccgggcccuuugaagcccagggcgccauucaaaguaugcucugcacua

SEQ ID NO: 2254403 - RNA, 128 nt, Homo sapiens
cuccugaucucaaaugauccacccaccuuggccuuccaaagugcugggacuggccggggaugauggcucacgccuguaaucccagcacuuugggaggcugaggcggguggaaaucacaaggucaggag

SEQ ID NO: 2254404 - RNA, 129 nt, Homo sapiens
uaauaauaaucuguagaagaauguuuaauaaaagauguauacuaggguaguaauaguuguuucaaggcaauggauuguaagugacuuuuauuauguuuaucuguauuuuucuaaaaggaauaugaauug

SEQ ID NO: 2254405 - RNA, 60 nt, Homo sapiens
aucuuuggucaucacagcuagaggaaggcuacugguaucuaguggguagagaccagggau

SEQ ID NO: 2254406 - RNA, 97 nt, Homo sapiens
gggaggagaaucucuugagcccgggagauggagguuguggugagccaagaucgcgccauugcacuccagccugggcaacgagagcgaaacuccuucu

SEQ ID NO: 2254407 - RNA, 73 nt, Homo sapiens
aagggggagaauaugugaagggggcuuccaugggaggcuucgauggcccacccacccuuccauucuuccucuu

SEQ ID NO: 2254408 - RNA, 108 nt, Homo sapiens
caguagggacaggaggauuuugugggggcucgugucacugugaggauauuguaguggugguagcugcuacucccacagugacacagacccauucccaaagcccuacug

SEQ ID NO: 2254409 - RNA, 88 nt, Homo sapiens
ggguugguuccaagucuuugcuauuguaaauagugcugcaguaaauauacaugugcauaugucuuuauaguagaaugauuuauaaucc

SEQ ID NO: 2254410 - RNA, 71 nt, Homo sapiens
uauugggugauauguugagguuuuggguacaaauuaucccgucacccagguagugagcauagcacccaaua

SEQ ID NO: 2254411 - RNA, 56 nt, Homo sapiens
acccaguagucauucaggagcagguucaguuuccauguaguugagugguuuugggu

SEQ ID NO: 2254412 - RNA, 90 nt, Homo sapiens
cucuuuucuuauuuauuacauaguaacauuucuaguagagaguggggccuuuguuaugucacauuuuuuaugaaauguuuaaagaaggag

SEQ ID NO: 2254413 - RNA, 67 nt, Homo sapiens
uuaugcuauauguauugagggguggaaacuggauuagauuaacugcccuuaucaguggcaaguauaa

SEQ ID NO: 2254414 - RNA, 85 nt, Homo sapiens
ucccaucucagccccugaguagcuaagacgauaggcauacaccacuaugcccagcuaauuuuaguauucuuuuguagagaugggg

SEQ ID NO: 2254415 - RNA, 130 nt, Homo sapiens
uggguaaauuaagucccagccuugacagaguuggcugaaagagguuuuagugagucccacugaggucuuaucggugggaaggguuggaaccaccucagcucucuugucaagucaguaggaaauuuaucca

SEQ ID NO: 2254416 - RNA, 130 nt, Homo sapiens
ggcacggugugcgcaugugugacgagaccugggggcacgugugugcugugcucagcucuccuaauacugggagauggaacagacacugcgugcuggcugggagucgucgcuaggccaucucauccuagcc

SEQ ID NO: 2254417 - RNA, 112 nt, Homo sapiens
ggacaaugcaaugugacucagaaaaucuguuuauucauccuguuucaccaauuccuaguugggugucauggggaaaauaacagacuucucaggaguuaaguuuucuuugucc

SEQ ID NO: 2254418 - RNA, 101 nt, Homo sapiens
auccauacgcauuaucucauuuuucuucacaccugccuaguggcacaguuacugucaauugucaccauuuguaggugaggagacugaggcuuagagggggu

SEQ ID NO: 2254419 - RNA, 62 nt, Homo sapiens
ccagauauuccuaauaguuggaagcuucaguguccaaugagucagcuaccugggaaauuugg

SEQ ID NO: 2254420 - RNA, 75 nt, Homo sapiens
uucccuauuuagaucuuuaaaaggugcuagauucucagucagucucuucaguauugggagggucuggaaggggaa

SEQ ID NO: 2254421 - RNA, 68 nt, Homo sapiens
cgaaacuacuuugugauuugugcauucaacucacagaguugaaccauucuuuugauagagcaguuuug

SEQ ID NO: 2254422 - RNA, 66 nt, Homo sapiens
ucacaggguguuauuagaauuaaaucaaauaaugaauuaucacagugcucuguaacauccuguuga

SEQ ID NO: 2254423 - RNA, 90 nt, Homo sapiens
uggaguucuuuagugugucaauuuaugucauucauaaauuaugcaagcccauuacaugggugaguaugaguugacuucuaauucauucua

SEQ ID NO: 2254424 - RNA, 79 nt, Homo sapiens
aggcuagagugcagugacaugaucuuggcucacuacaaccuccaccuccuggguucaagcaauucgccugucucagccu

SEQ ID NO: 2254425 - RNA, 104 nt, Homo sapiens
ggagaaaauucaaacaauuuaguguagcauucagagucaacucugucuuuaucuucuaucucuuacgguggcucuguuuguuaacuagacuggucuuauucucc

SEQ ID NO: 2254426 - RNA, 98 nt, Homo sapiens
auauuuggugggaacauuuaggggagucauuaacacaaugcaaaacacauaaauuuugcauuguauuguugacucgccuaaguguccccacaaaaugu

SEQ ID NO: 2254427 - RNA, 64 nt, Homo sapiens
ugucacuuugccuucuggacuuuggagucuuuccaggaagaaauaaguuuaggggaaagugaca

SEQ ID NO: 2254428 - RNA, 97 nt, Homo sapiens
uaguaagcuuggaaauguuuagauagcaucauuucuugaaaagaauguguauucucuuguuggaugugguguucuguacauuuaaauuugguuacua

SEQ ID NO: 2254429 - RNA, 60 nt, Homo sapiens
caggguaaaccuaugagauagcuguugcuauugacauuucuaucucaguguuuacauuug

SEQ ID NO: 2254430 - RNA, 61 nt, Homo sapiens
uaaggauuuuggugauuacacugagcccaccaggauagucucccugaucucaagauccuua

SEQ ID NO: 2254431 - RNA, 70 nt, Homo sapiens
aagguuuggcuccguuguacaggcuggagugcagugaugcaaucucagcucauggcagccuugaacgcuu

SEQ ID NO: 2254432 - RNA, 89 nt, Homo sapiens
guuagagagggguagggcugaaaguuccagacuuuaaaguuauaauucagcuauaaagccuagaacuuucagcccuaucccucucuaac

SEQ ID NO: 2254433 - RNA, 65 nt, Homo sapiens
uuuggcuuguaaaaugaaaagcuaucaagcugaauugccuugaaaguuuuauauuauaagcuaaa

SEQ ID NO: 2254434 - RNA, 82 nt, Homo sapiens
augaagucuuugcccaugcccauguucugaaggguauugccuagguuuucuucuaugguuuuuaugguguuaggucuuacau

SEQ ID NO: 2254435 - RNA, 71 nt, Homo sapiens
acugaccaaugacauugaagagcugggccccuacacccuggacaggaacagucucuaugucaauggugagu

SEQ ID NO: 2254436 - RNA, 55 nt, Homo sapiens
gcugggaggcuguuggggugaucuaagcaagagauuauaacaguuuggacccagu

SEQ ID NO: 2254437 - RNA, 89 nt, Homo sapiens
auuucuaagcuauaguaacagguauagaaagcuaaagggauaagauauuguaucuaaccuguuuuuagauucuguaccuccuuagaaau

SEQ ID NO: 2254438 - RNA, 129 nt, Homo sapiens
auuguggaugcgugcaccugcgcuuccugucgagaacauucauuaugcaaaagucaggaaaggagaaacagaacugucauuuggauugugaaaguauucucuggggagcugcccuacuguaucuauaau

SEQ ID NO: 2254439 - RNA, 89 nt, Homo sapiens
gggaggaucgcuugagcccgggaugcggaaguugcagugagccaaaauagugccauugcagcccacccugggugauagaaugagagccu

SEQ ID NO: 2254440 - RNA, 68 nt, Homo sapiens
aaaagaacuugauauucugagaagcugaagaacaauuuguuuuccucagcuagguauuuaggacuuuu

SEQ ID NO: 2254441 - RNA, 81 nt, Homo sapiens
uuucauugacaguuggccaguaagugauucaacuccuaaccuuauucuuggaccacuccugaaacaacugucuuggugaaa

SEQ ID NO: 2254442 - RNA, 85 nt, Homo sapiens
agaaaugcuugucaaugggugagugcagagacauccuggggucuggucccaguucugcccuuaauguauuggacaauucauuucu

SEQ ID NO: 2254443 - RNA, 56 nt, Homo sapiens
agaggacugcuguuguuaacuuuuggagggccuagcucacaaaacagcuguguucu

SEQ ID NO: 2254444 - RNA, 77 nt, Homo sapiens
augguauugguaugguauugguaugcucugaaaaaaccaaugcuuuuucagagcaaagacacuuuaucaaauacuau

SEQ ID NO: 2254445 - RNA, 82 nt, Homo sapiens
uuuugcuuuugccuuuguucuggaaugggaagcugucugggaggaaguacuuccugagccaagaacugaaggguaaguaaga

SEQ ID NO: 2254446 - RNA, 81 nt, Homo sapiens
ccuccgaugcugcuuugguagaaaucuuugguuuggagucagacacuuuggugccaagacagguuuuuauaaguuaggagg

SEQ ID NO: 2254447 - RNA, 74 nt, Homo sapiens
ugcucgagcacgggaggucgagguugcagugagccaggauggugccacugcacuccaucuuagguggcagagca

SEQ ID NO: 2254448 - RNA, 82 nt, Homo sapiens
gguuggggcugugaguuccuugugugaccuugcugccacagagaugaagaaggggaaggcagggagcucgccugucccagcc

SEQ ID NO: 2254449 - RNA, 78 nt, Homo sapiens
ugguugucacccuggucuggagagucccgcccagagaacauuuugggcacuaguccagagccuuggguuugaaugcca

SEQ ID NO: 2254450 - RNA, 58 nt, Homo sapiens
ggucacuuuaccccuuggagccucagcuguggggaggauucaugggagcaaagaggcc

SEQ ID NO: 2254451 - RNA, 73 nt, Homo sapiens
ccuccuaggaacuuuuauaaucaccaguaugauccaauauaaauacugcacauaugaagguucccaguugagg

SEQ ID NO: 2254452 - RNA, 58 nt, Homo sapiens
ugagacagggucuugcucuuucacccaggcuggagugcaauggcaagaucuuggcuca

SEQ ID NO: 2254453 - RNA, 77 nt, Homo sapiens
cuaaaguucuucugagagaacaauuaugcaugugacuccuuuucuugcgucugauuucucauuagaaaggaccuugg

SEQ ID NO: 2254454 - RNA, 128 nt, Homo sapiens
uugauuaaaaucugucuuuaccacuuuaacuagagcccuguguuguucaucuuugacauucccccagcaaaguuggcacugaauugcaauggacaaugcagcagcugcucucagguagaggcccucaa

SEQ ID NO: 2254455 - RNA, 69 nt, Homo sapiens
guuagugagccaugauuuuaccacugcacuccaaccugggcaacagaggaagaccgugucucaaaaaac

SEQ ID NO: 2254456 - RNA, 129 nt, Homo sapiens
cuggcugagaccugucaccauuugaguuugugaacucugaucuacguaugaaguucuacuggcuccgaggagcugugauucuguguagauagucuugcauacugcuaaaauagguuuuuuacuuuccag

SEQ ID NO: 2254457 - RNA, 102 nt, Homo sapiens
auggaaaguggcuguggaucugggugaaucagugagugguuagugaaugugaaagccuaggacaucacuaucuacuacuguagacuuauaaacacuguauau

SEQ ID NO: 2254458 - RNA, 88 nt, Homo sapiens
aaugacugaaacucagcucugguuacaaaggcaaauuucuaguuagguuuucaguuuguuuauguacuaagcuagguugcaguucauu

SEQ ID NO: 2254459 - RNA, 67 nt, Homo sapiens
agucauagaguuugcccuucucacuucaaaaauggagaaacagccuagagggguaaauucugucacu

SEQ ID NO: 2254460 - RNA, 61 nt, Homo sapiens
uuucuuugaguguauacuuagauuugugggaucauaagucuauguuuaacauuuugaggaa

SEQ ID NO: 2254461 - RNA, 86 nt, Homo sapiens
uauucauuaaauuccuuccaguugugagcuauccgggcuuuaagggaccugaagcucaaaugacuuggggaggcuuuuaaggaaua

SEQ ID NO: 2254462 - RNA, 65 nt, Homo sapiens
cuuugaggacuggaacacaggucuacagauggaugacaaugggauuaugagacccagccucaaag

SEQ ID NO: 2254463 - RNA, 89 nt, Homo sapiens
ggagaauugcuugaacccaagagguggagguugcagugagccaagauugcgccauugcacuccgcccugggcaaaaagagugaaacucc

SEQ ID NO: 2254464 - RNA, 83 nt, Homo sapiens
gauuguggauugugaagaccaugggaaaaguguaguaugugggccagaaugcaccauuccucauggcacagucccucacgguu

SEQ ID NO: 2254465 - RNA, 60 nt, Homo sapiens
guguguguguguguguguguguguguguguguguguguguaccuacugcaugccaggcac

SEQ ID NO: 2254466 - RNA, 62 nt, Homo sapiens
acaucuggcugcacugugagcuugggaacuucuucgguaaauagcaucacagagccgggugu

SEQ ID NO: 2254467 - RNA, 73 nt, Homo sapiens
gaucacaauuguacguaggagccaaaaagaacauggauaauacaugaaacagguuuguaugaauagugugauu

SEQ ID NO: 2254468 - RNA, 58 nt, Homo sapiens
ggucaacaucaucaugguaagugauauugacaguacguacccuugauaggaugugacc

SEQ ID NO: 2254469 - RNA, 78 nt, Homo sapiens
uaauccuucauguugaaagcuccugugguuuauagcaaaauagggcuuuggacugucagggcuauuagucaaggguua

SEQ ID NO: 2254470 - RNA, 56 nt, Homo sapiens
cuguguggccuaaguggagacacaggcccugcccucuccacugagcgucacggcag

SEQ ID NO: 2254471 - RNA, 64 nt, Homo sapiens
guuuucaucugaaccacaaggcccgccacaguccauggcaagugucugguguuuuaaugaggac

SEQ ID NO: 2254472 - RNA, 102 nt, Homo sapiens
gggguccugcaccugggaaggcacaccgagggagaggggcgggaagcaucuaagauuccauuuguucggugucgccauuccgcugggagggucaggaacccc

SEQ ID NO: 2254473 - RNA, 60 nt, Homo sapiens
gcagugcaugacgguauauauauauacaggcacagcuuguuuuaucaugcuucacacugu

SEQ ID NO: 2254474 - RNA, 57 nt, Homo sapiens
uucauuuuuuuauaugcauaucacaauucugugugauaugaaagggaaauaagugaa

SEQ ID NO: 2254475 - RNA, 78 nt, Homo sapiens
gccacaauagugugugauuucaagucuuaaaaaccagaaucacuuucuucucuggacuggaagcauauuuauuuuggc

SEQ ID NO: 2254476 - RNA, 68 nt, Homo sapiens
cuguuucucaggccugggacucgggcacacagcugcucaguuguauguuucuuaggccugagacaugg

SEQ ID NO: 2254477 - RNA, 103 nt, Homo sapiens
uacaggugugagccacugcgccuggccugaaaauacaugguccugagccucaacucaccugugcaaguuauaggccaggucaauggcgaugaguacaccugug

SEQ ID NO: 2254478 - RNA, 78 nt, Homo sapiens
cauuaauaguggcugcugaguucacaucuaaaugggaaaugugccacguggagugaaaacacacuaaucuauuguaug

SEQ ID NO: 2254479 - RNA, 64 nt, Homo sapiens
cagucaagguguaggaguaaagaagucaaauauuuaugugugauuuauagcuacaucuugacug

SEQ ID NO: 2254480 - RNA, 92 nt, Homo sapiens
cauuuuguuuuuaguuuggcaagcuguuaauuauaaaaaaggggaaauuuuagaacuuauuugucuugauggcaauguuagagaacaaaaug

SEQ ID NO: 2254481 - RNA, 78 nt, Homo sapiens
ggcugcccagugauggcugccucauuugggauuuauuauaauaucauuagaagggguuauaucacuugguauaauguc

SEQ ID NO: 2254482 - RNA, 80 nt, Homo sapiens
uuggaaauguguaaagcuuuucuuuguucagugagucuuuucauuauuuaaaauagagagcagcuuugcgguuuucucaa

SEQ ID NO: 2254483 - RNA, 60 nt, Homo sapiens
cugaacagguacugugcacacauggacacugaacagguacuguggcacuguaucucucag

SEQ ID NO: 2254484 - RNA, 129 nt, Homo sapiens
gucaugccaugaaacacuugaccaagcaugggucaaagccaccaacacaucccauuuuguagugccuugcaaaucuuguguaguugugagcuaugauuuauuucauguaaguguauuguggugcguggc

SEQ ID NO: 2254485 - RNA, 81 nt, Homo sapiens
uuuccuccccucagagcacaguuuaugacaguucaaguuuuguucucuguucuguaagcugcuguugugcaagggaggaga

SEQ ID NO: 2254486 - RNA, 64 nt, Homo sapiens
guuuucuuguuuccaaaauggcaaaucaguuaggauuaaguuuggugccauguaacaggaaaau

SEQ ID NO: 2254487 - RNA, 71 nt, Homo sapiens
ucacuccucaggcuagcaucaucugggggccgcauacacaucugguaaauugauguugaccuaaguaguga

SEQ ID NO: 2254488 - RNA, 61 nt, Homo sapiens
uauuccugaauuguguguguugauauguuguuacaggucuuugcauguauguucaugaaua

SEQ ID NO: 2254489 - RNA, 58 nt, Homo sapiens
uuuuacacuguugguuggaauguaaucuagaacaaucccuauggaaaacaguguggag

SEQ ID NO: 2254490 - RNA, 82 nt, Homo sapiens
auugaaagugcuuaaguuaucucuguaccuuugucugcagccccuaugcucagugcuuggcacagagagcugcuugcucaau

SEQ ID NO: 2254491 - RNA, 93 nt, Homo sapiens
ggguauuuggaauauuauaauauagcaauuugggaaucagacuuuuccccaucuccagaguuuguuuuacuuguuguaguugguauuguaucu

SEQ ID NO: 2254492 - RNA, 104 nt, Homo sapiens
gguuaggacauauaguauuauuugauagacacauauccaugugaaaaaucaguugacacgugagagggcgaugugucuauuucauaugucuagguuugucaacc

SEQ ID NO: 2254493 - RNA, 67 nt, Homo sapiens
ucccugucuccggcuguccuuugagguuuugguucaggagacccagaguggagccuggggauagggg

SEQ ID NO: 2254494 - RNA, 55 nt, Homo sapiens
uauaugcaacauaguguauguguguaugugcacccaugcaugcuguguguaugua

SEQ ID NO: 2254495 - RNA, 71 nt, Homo sapiens
gaaugacuacuucaauucugaagauucagggaggcauucugaauguucuggauggaagaguuaaacucuuc

SEQ ID NO: 2254496 - RNA, 71 nt, Homo sapiens
uggggaucacagagcuugggaaaggaaugucaacacuggaaggcaggucugaguccaagucuguguccuca

SEQ ID NO: 2254497 - RNA, 78 nt, Homo sapiens
gacagauauuaaugugcaaauuagcacaacccgacuggguccagauugccacuuagaauuugcauauuaauaaauguu

SEQ ID NO: 2254498 - RNA, 65 nt, Homo sapiens
caccccuaccugagucaggaguggagauuagcccaaauuaaagcucuggugacucaggagaggug

SEQ ID NO: 2254499 - RNA, 55 nt, Homo sapiens
cugagaucguggggcugcuguccaaccuagaagacagaguaagacccauucucgg

SEQ ID NO: 2254500 - RNA, 58 nt, Homo sapiens
uugaguuugaguauucuaaagcugguucauaaaguugcuuuaguguaaucuuauucaa

SEQ ID NO: 2254501 - RNA, 55 nt, Homo sapiens
uguggcacuguguccagagaaaccgguguacuaguugacuuagguucgggccaca

SEQ ID NO: 2254502 - RNA, 111 nt, Homo sapiens
guuugaauucauagugccuaauucuguaccuggcacauaaaagauguucaguuaaugugugcugaauacagaauucuuugaacaccaggccuucccuuacugauuucaaac

SEQ ID NO: 2254503 - RNA, 69 nt, Homo sapiens
gggauacauauggagguuuguuacaagaguauauugcacgauaccaaaguuucggccucuguugauccc

SEQ ID NO: 2254504 - RNA, 73 nt, Homo sapiens
gagaaaucuccacacuguuuuccauggggguugaacuaauuuacauucccaccaacaguguacaaguguucuc

SEQ ID NO: 2254505 - RNA, 73 nt, Homo sapiens
uggcacuaauagagucauuauuauuguucucacagauuagauggcagagccagugaugaagacucuggagcca

SEQ ID NO: 2254506 - RNA, 55 nt, Homo sapiens
uuccugcacuugcuugccuaugugcuccuucccacgaggggugaagugcagcgga

SEQ ID NO: 2254507 - RNA, 111 nt, Homo sapiens
cagggccgcucuccagcugugcucccuagacuccugccuuucagggccagcuuucaggaccuugagggcagggugcuaggcauaagccagugaucuuacuaguggauucug

SEQ ID NO: 2254508 - RNA, 57 nt, Homo sapiens
gcucccaguggucuugaaacagggacacuaaacugaucccucugcuacacugggagc

SEQ ID NO: 2254509 - RNA, 57 nt, Homo sapiens
ggcaugaucuuggcucacugcaaccuccgccucccagguucaagcuauugucaugcc

SEQ ID NO: 2254510 - RNA, 86 nt, Homo sapiens
uuccagagaucaggauguggacuuuuauggaggguagaaagggauauuauucugccaaccacaaaauuuauucuugacuuuuggag

SEQ ID NO: 2254511 - DNA, 22 bp, Homo sapiens
tagcttatcagactgatgttga

SEQ ID NO: 2254512 - DNA, 22 bp, Homo sapiens
ttcacagtggctaagttctgca

SEQ ID NO: 2254513 - DNA, 22 bp, Homo sapiens
aaagaattctccttttgggctt

SEQ ID NO: 2254514 - DNA, 22 bp, Homo sapiens
aagtgctgttcgtgcaggtagt

SEQ ID NO: 2254515 - DNA, 22 bp, Homo sapiens
tcaagtaatccaggataggctg

SEQ ID NO: 2254516 - DNA, 22 bp, Homo sapiens
aacggaatcccaaaagcagctg

SEQ ID NO: 2254517 - DNA, 22 bp, Homo sapiens
ggcaagatgctggcatagctgt

SEQ ID NO: 2254518 - DNA, 22 bp, Homo sapiens
tattgcacttgtcccggcctgt

SEQ ID NO: 2254519 - DNA, 22 bp, Homo sapiens
atcacattgccagggattacca

SEQ ID NO: 2254520 - DNA, 22 bp, Homo sapiens
gaagtttgaagcctgttgttca

SEQ ID NO: 2254521 - DNA, 22 bp, Homo sapiens
cactgcactccagcctgggcaa

SEQ ID NO: 2254522 - DNA, 22 bp, Homo sapiens
taggtagtttcctgttgttggg

SEQ ID NO: 2254523 - DNA, 22 bp, Homo sapiens
tcacagtgaaccggtctctttc

SEQ ID NO: 2254524 - DNA, 22 bp, Homo sapiens
taaggtgcatctagtgcagtta

SEQ ID NO: 2254525 - DNA, 22 bp, Homo sapiens
ctagactgaagctccttgagga

SEQ ID NO: 2254526 - DNA, 22 bp, Homo sapiens
taatactgccgggtaatgatgg

SEQ ID NO: 2254527 - DNA, 22 bp, Homo sapiens
tagcagcacataatggtttgaa

SEQ ID NO: 2254528 - DNA, 22 bp, Homo sapiens
aaagtgctcatagtgcaggtag

SEQ ID NO: 2254529 - DNA, 22 bp, Homo sapiens
tttccacagcggccaattcttc

SEQ ID NO: 2254530 - DNA, 22 bp, Homo sapiens
agctgccagttgaagaacattt

SEQ ID NO: 2254531 - DNA, 22 bp, Homo sapiens
aagttaagagctcccaggcctg

SEQ ID NO: 2254532 - DNA, 22 bp, Homo sapiens
actgcactccagcctgggcaac

SEQ ID NO: 2254533 - DNA, 22 bp, Homo sapiens
gtgttccaggaagtcgtcttga

SEQ ID NO: 2254534 - DNA, 22 bp, Homo sapiens
tcaagctcattcctctaacctc

SEQ ID NO: 2254535 - DNA, 22 bp, Homo sapiens
cattgcactccagcctgggcaa

SEQ ID NO: 2254536 - DNA, 22 bp, Homo sapiens
acatgatctcctcactctagga

SEQ ID NO: 2254537 - DNA, 22 bp, Homo sapiens
aattgcttgaacccaggaagtg

SEQ ID NO: 2254538 - DNA, 22 bp, Homo sapiens
tgtttaagtagcttatttatct

SEQ ID NO: 2254539 - DNA, 22 bp, Homo sapiens
tctaagagaaaggaagttcaga

SEQ ID NO: 2254540 - DNA, 22 bp, Homo sapiens
gaaggcagtaggttgtatagtt

SEQ ID NO: 2254541 - DNA, 22 bp, Homo sapiens
atcacattgccagtgattaccc

SEQ ID NO: 2254542 - DNA, 22 bp, Homo sapiens
ttggagtaattcagtataggtt

SEQ ID NO: 2254543 - DNA, 22 bp, Homo sapiens
agtagacagtggcaacatagtc

SEQ ID NO: 2254544 - DNA, 22 bp, Homo sapiens
ctagcctgtttgtcctcacccc

SEQ ID NO: 2254545 - DNA, 20 bp, Homo sapiens
tgaggtgggatcccgaggcc

SEQ ID NO: 2254546 - DNA, 17 bp, Homo sapiens
tggctaggtaagggaag

SEQ ID NO: 2254547 - DNA, 23 bp, Homo sapiens
aatcatcattattttgaagttta

SEQ ID NO: 2254548 - DNA, 17 bp, Homo sapiens
taaggcatttttatggt

SEQ ID NO: 2254549 - DNA, 22 bp, Homo sapiens
gctgttgttaagggcacttggg

SEQ ID NO: 2254550 - DNA, 22 bp, Homo sapiens
ttcatgggagcaggtggtacag

SEQ ID NO: 2254551 - DNA, 22 bp, Homo sapiens
actgcactccagtctgggtgac

SEQ ID NO: 2254552 - DNA, 22 bp, Homo sapiens
tcactgcaacctctgcctcccg

SEQ ID NO: 2254553 - DNA, 22 bp, Homo sapiens
cagatcacatccatccgtcacc

SEQ ID NO: 2254554 - DNA, 22 bp, Homo sapiens
gcactcaagcctgggttacaga

SEQ ID NO: 2254555 - DNA, 22 bp, Homo sapiens
agagagtggcaggtctgttcct

SEQ ID NO: 2254556 - DNA, 18 bp, Homo sapiens
gatgaggcagcacttggg

SEQ ID NO: 2254557 - DNA, 22 bp, Homo sapiens
tgaggtgggagaattgcttgaa

SEQ ID NO: 2254558 - DNA, 22 bp, Homo sapiens
catgtaatcccagctactcagg

SEQ ID NO: 2254559 - DNA, 22 bp, Homo sapiens
tagcaccatttgaaatcggtta

SEQ ID NO: 2254560 - DNA, 22 bp, Homo sapiens
cagtgcaatgatgaaagggcat

SEQ ID NO: 2254561 - DNA, 22 bp, Homo sapiens
tgtaaacatccttgactggaag

SEQ ID NO: 2254562 - DNA, 705 bp, Homo sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 2254563 - DNA, 87 bp, Homo sapiens
cccgtgaggaacagtggcgggattgtcccagggccccttccagcagggggacctcctgacttgagagtccccaaagccttcccaggg

SEQ ID NO: 2254564 - DNA, 90 bp, Homo sapiens
ctccacctgtttgctagcataacaggcgtgaaggcggcagtgtcgccggcgtccttccgcggaagcccagtgtgtgcagacagcacgggg

SEQ ID NO: 2254565 - DNA, 60 bp, Homo sapiens
tgggttcctggcatgctgatttgtgacttaagattaaaatcacattgccagggattacca

SEQ ID NO: 2254566 - DNA, 126 bp, Homo sapiens
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 2254567 - DNA, 74 bp, Homo sapiens
aggtgcaggagcttagctgattggtgaacagtgattggtttccgctttgttcacagtggctaagttctgcacct

SEQ ID NO: 2254568 - DNA, 88 bp, Homo sapiens
ctctaacaaggtgcaggagcttagctgattggtgaacagtgattggtttccgctttgttcacagtggctaagttctgcacctgaagag

SEQ ID NO: 2254569 - DNA, 81 bp, Homo sapiens
tggggacagttaagttggagccgctggggcagaggccgttgctgacgggccggccgctgctgcacagtcagcttgggtgcg

SEQ ID NO: 2254570 - DNA, 80 bp, Homo sapiens
ggtcaaatgtattgaaagttgcaaaaattcttcttacaaacataaagtgtgctgaatccactacgtaaaccaaaatcaaa

SEQ ID NO: 2254571 - DNA, 82 bp, Homo sapiens
ggctgtgagcggggcggggcggggctttcggaggagctcctgttgttctgggcgcggtgaactctctcttgtatttgcagtc

SEQ ID NO: 2254572 - DNA, 68 bp, Homo sapiens
ctccggtgcctactgagctgatatcagttctcattttacacactggctcagttcagcaggaacaggag

SEQ ID NO: 2254573 - DNA, 86 bp, Homo sapiens
tagcagctattgtgtacgcaaagcctgagtacagcctgctggtgtcatggccacgtgtgagcaggccagcgtcacacggctcgctg

SEQ ID NO: 2254574 - DNA, 15 bp, Artificial Sequence
  Synthetic
tttaaccgcattctc

SEQ ID NO: 2254575 - DNA, 20 bp, Artificial Sequence
  Synthetic
tactaatacgactcactaaa

SEQ ID NO: 2254576 - DNA, 30 bp, Artificial Sequence
  Synthetic
gactagctggaattcaaggatgcggttaaa

SEQ ID NO: 2254577 - DNA, 30 bp, Artificial Sequence
  Synthetic
cagccaacgctgcagatacgactcactaaa

SEQ ID NO: 2254578 - DNA, 50 bp, Artificial Sequence
  Synthetic
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 2254579 - DNA, 20 bp, Artificial Sequence
  Synthetic
ggaattcaaggatgcggtta

SEQ ID NO: 2254580 - DNA, 10 bp, Artificial Sequence
  Synthetic
  misc_feature (3)..(4): n is a, c, g or t
  misc_feature (8)..(9): n is a, c, g or t
ggnngggnng

SEQ ID NO: 2254581 - DNA, 12 bp, Artificial Sequence
  Synthetic
tttaaccgcatc

SEQ ID NO: 2254582 - DNA, 12 bp, Artificial Sequence
  Synthetic
cgactcactaaa

SEQ ID NO: 2254583 - DNA, 40 bp, Artificial Sequence
  Synthetic
taatacgactcactataggcccttattagaggattctgct

SEQ ID NO: 2254584 - DNA, 41 bp, Artificial Sequence
  Synthetic
aattaaccctcactaaaggtttttttttcctgagacagagt

SEQ ID NO: 2254585 - DNA, 42 bp, Artificial Sequence
  Synthetic
taatacgactcactatagggtgaggtagtaagttgtattgtt

SEQ ID NO: 2254586 - DNA, 41 bp, Artificial Sequence
  Synthetic
aattaaccctcactaaagggaaagtagtaagttgtatagtt

SEQ ID NO: 2254587 - DNA, 20 bp, Artificial Sequence
  Synthetic
gaggcaggagaattgcttga

SEQ ID NO: 2254588 - DNA, 39 bp, Artificial Sequence
  Synthetic
aattaaccctcactaaaggcctgagacagagtcttgctc

SEQ ID NO: 2254589 - DNA, 80 bp, Homo sapiens
gtgaggtagtaagttgtattgttgtggggtagggatattaggccccaattagaagataactatacaacttactactttcc

SEQ ID NO: 2254590 - DNA, 22 bp, Homo sapiens
tgaggtagtaagttgtattgtt

SEQ ID NO: 2254591 - DNA, 100 bp, Homo sapiens
gaggcaggagaattgcttgaacccaggaagtggaggcttcagtgagctgagaacacgccactgcactccagtcctgggcaacagagcaagactctgtctc

SEQ ID NO: 2254592 - DNA, 24 bp, Homo sapiens
aattgcttgaacccaggaagtgga
